United States Patent 7,745,391 (HUMAN THROMBOSPONDIN POLYPEPTIDE) - sequence listing, part 83

SEQ ID NO: 287035 - DNA, 7032 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccatgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttattttgctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacaaaactgcaacagccaccccaactttcaagcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagcccgggcgtggtggcgcatgcctgtaattccagctacttgggaggctgagacgggaccattgcctgaacccggtcggcggaggtttctgtgagtggagactgcaccattgcactcaagcctgggcaacacagaatgaaactgtctccaaaataaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcgggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcaggtactgtggacgggcggcggagttcgggagacaggggcagggcggcatcggggagctgcgggacggggcggggaggaggcccgaggtctgagccacccgtgaggtctcggcgcggaggcctggacagctgggggtggcggcgttggtctcccgaactggagggaggccgggccttcccgggctgtggtgggcgcccgcgccccgtggaaggcggaggcgtgagtcggggcgtcagagacgttgccattctttgtcagcggaaaagatcgtcgtctgcgcacagtcacctgaggtttaggaactcgtggaactggaaaccgagtcgcaggagactaagagttgcgagtctccccttagagaattcagaaacaagcgtagacagcatcgtcagaaacacgagcgtgacgacaccggcctccccgtgccgagtccacgcgtgtgacgcgggtgcatacacctgcgtccgtgcaagagggtgacagcaacacactcaaggcgcttctcctgggaatggagcaggagaagagatggggagcatcgcatagatggaactagacctttttcttgggttggatgatgtgttcccgcgtctactacatgtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagtta

SEQ ID NO: 287036 - DNA, 7038 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccatgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttattttgctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacaaaactgcaacagccaccccaactttcaagcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagcccgggcgtggtggcgcatgcctgtaattccagctacttgggaggctgagacgggaccattgcctgaacccggtcggcggaggtttctgtgagtggagactgcaccattgcactcaagcctgggcaacacagaatgaaactgtctccaaaataaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcgggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaagggtgctgctttgaaacagtctttcttgtaaagcgatttgtgtaggcatttccgatttgctgagaagagcactctgttcaaggaagtgcagtcttcagtaataccgtattttctcgttggttccagttcgttaaatagtgtggtcattagcatctgctttgctgtcttcctgttacagcgatttctcttcacttcatgcctgttactcggcttcttcagagttattctggattcatagaagagggactagccctgacatacagcagcagcctagcctctaatatttctagagagtggagagaggcgggcaccatgcagggaagcgtgtgccttcaccactttccgagaactgaatgtccttgatagggaacttgactgccggaaaggggccaccagcatcaccatttccttcactcgacggccaacttccttgcccagtgcagagctcttcctcaccatagccatgcagagactatgcatgtggataaaccatgggaaaaagcaaaagcagcagcaagttactaatgttattctgaactgcagggagagaatttggcaaataactggtacttaaggctaaaataattgttatttcttttgctttcaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagtta

SEQ ID NO: 287037 - DNA, 7638 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccatgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttattttgctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacaaaactgcaacagccaccccaactttcaagcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagcccgggcgtggtggcgcatgcctgtaattccagctacttgggaggctgagacgggaccattgcctgaacccggtcggcggaggtttctgtgagtggagactgcaccattgcactcaagcctgggcaacacagaatgaaactgtctccaaaataaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcgggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcaggtactgtggacgggcggcggagttcgggagacaggggcagggcggcatcggggagctgcgggacggggcggggaggaggcccgaggtctgagccacccgtgaggtctcggcgcggaggcctggacagctgggggtggcggcgttggtctcccgaactggagggaggccgggccttcccgggctgtggtgggcgcccgcgccccgtggaaggcggaggcgtgagtcggggcgtcagagacgttgccattctttgtcagcggaaaagatcgtcgtctgcgcacagtcacctgaggtttaggaactcgtggaactggaaaccgagtcgcaggagactaagagttgcgagtctccccttagagaattcagaaacaagcgtagacagcatcgtcagaaacacgagcgtgacgacaccggcctccccgtgccgagtccacgcgtgtgacgcgggtgcatacacctgcgtccgtgcaagagggtgacagcaacacactcaaggcgcttctcctgggaatggagcaggagaagagatggggagcatcgcatagatggaactagacctttttcttgggttggatgatgtgttcccgcgtctactacatgtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaagggtgctgctttgaaacagtctttcttgtaaagcgatttgtgtaggcatttccgatttgctgagaagagcactctgttcaaggaagtgcagtcttcagtaataccgtattttctcgttggttccagttcgttaaatagtgtggtcattagcatctgctttgctgtcttcctgttacagcgatttctcttcacttcatgcctgttactcggcttcttcagagttattctggattcatagaagagggactagccctgacatacagcagcagcctagcctctaatatttctagagagtggagagaggcgggcaccatgcagggaagcgtgtgccttcaccactttccgagaactgaatgtccttgatagggaacttgactgccggaaaggggccaccagcatcaccatttccttcactcgacggccaacttccttgcccagtgcagagctcttcctcaccatagccatgcagagactatgcatgtggataaaccatgggaaaaagcaaaagcagcagcaagttactaatgttattctgaactgcagggagagaatttggcaaataactggtacttaaggctaaaataattgttatttcttttgctttcaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagtta

SEQ ID NO: 287038 - DNA, 1911 bp, Homo sapiens
ctggataagactcgtggccggaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagtta

SEQ ID NO: 287039 - DNA, 2359 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtatcatatgtttcttacaaagtggaggtttgtggcagccctgcatggagcaagtctgtcagcaccatctttctaacatgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagtta

SEQ ID NO: 287040 - DNA, 6859 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccatgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttattttgctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacaaaactgcaacagccaccccaactttcaagcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagcccgggcgtggtggcgcatgcctgtaattccagctacttgggaggctgagacgggaccattgcctgaacccggtcggcggaggtttctgtgagtggagactgcaccattgcactcaagcctgggcaacacagaatgaaactgtctccaaaataaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcgggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcaggtactgtggacgggcggcggagttcgggagacaggggcagggcggcatcggggagctgcgggacggggcggggaggaggcccgaggtctgagccacccgtgaggtctcggcgcggaggcctggacagctgggggtggcggcgttggtctcccgaactggagggaggccgggccttcccgggctgtggtgggcgcccgcgccccgtggaaggcggaggcgtgagtcggggcgtcagagacgttgccattctttgtcagcggaaaagatcgtcgtctgcgcacagtcacctgaggtttaggaactcgtggaactggaaaccgagtcgcaggagactaagagttgcgagtctccccttagagaattcagaaacaagcgtagacagcatcgtcagaaacacgagcgtgacgacaccggcctccccgtgccgagtccacgcgtgtgacgcgggtgcatacacctgcgtccgtgcaagagggtgacagcaacacactcaaggcgcttctcctgggaatggagcaggagaagagatggggagcatcgcatagatggaactagacctttttcttgggttggatgatgtgttcccgcgtctactacatggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagtta

SEQ ID NO: 287041 - DNA, 7094 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccatgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttattttgctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacaaaactgcaacagccaccccaactttcaagcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagcccgggcgtggtggcgcatgcctgtaattccagctacttgggaggctgagacgggaccattgcctgaacccggtcggcggaggtttctgtgagtggagactgcaccattgcactcaagcctgggcaacacagaatgaaactgtctccaaaataaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcgggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaagggtgctgctttgaaacagtctttcttgtaaagcgatttgtgtaggcatttccgatttgctgagaagagcactctgttcaaggaagtgcagtcttcagtaataccgtattttctcgttggttccagttcgttaaatagtgtggtcattagcatctgctttgctgtcttcctgttacagcgatttctcttcacttcatgcctgttactcggcttcttcagagttattctggattcatagaagagggactagccctgacatacagcagcagcctagcctctaatatttctagagagtggagagaggcgggcaccatgcagggaagcgtgtgccttcaccactttccgagaactgaatgtccttgatagggaacttgactgccggaaaggggccaccagcatcaccatttccttcactcgacggccaacttccttgcccagtgcagagctcttcctcaccatagccatgcagagactatgcatgtggataaaccatgggaaaaagcaaaagcagcagcaagttactaatgttattctgaactgcagggagagaatttggcaaataactggtacttaaggctaaaataattgttatttcttttgctttcaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggtaaccagctctcctacacaaccatacaagctgaaacctaaacatactataaaaaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagtta

SEQ ID NO: 287042 - DNA, 6488 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccatgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttattttgctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacaaaactgcaacagccaccccaactttcaagcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagcccgggcgtggtggcgcatgcctgtaattccagctacttgggaggctgagacgggaccattgcctgaacccggtcggcggaggtttctgtgagtggagactgcaccattgcactcaagcctgggcaacacagaatgaaactgtctccaaaataaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcgggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggtaaccagctctcctacacaaccatacaagctgaaacctaaacatactataaaaaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagtta

SEQ ID NO: 287043 - DNA, 6381 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccatgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttattttgctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacaaaactgcaacagccaccccaactttcaagcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagcccgggcgtggtggcgcatgcctgtaattccagctacttgggaggctgagacgggaccattgcctgaacccggtcggcggaggtttctgtgagtggagactgcaccattgcactcaagcctgggcaacacagaatgaaactgtctccaaaataaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcgggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagtta

SEQ ID NO: 287044 - DNA, 2459 bp, Homo sapiens
ctggataagactcgtggccggaggctgatcagtgttctagaacagatcagacattttgtaatgatgcctgaaataaacactaaccacctcgacaagcaacaggttcaactcctggcagagatgtgtatccttattgatgaaaatgacggtgctgctttgaaacagtctttcttgtaaagcgatttgtgtaggcatttccgatttgctgagaagagcactctgttcaaggaagtgcagtcttcagtaataccgtattttctcgttggttccagttcgttaaatagtgtggtcattagcatctgctttgctgtcttcctgttacagcgatttctcttcacttcatgcctgttactcggcttcttcagagttattctggattcatagaagagggactagccctgacatacagcagcagcctagcctctaatatttctagagagtggagagaggcgggcaccatgcagggaagcgtgtgccttcaccactttccgagaactgaatgtccttgatagggaacttgactgccggaaaggggccaccagcatcaccatttccttcactcgacggccaacttccttgcccagtgcagagctcttcctcaccatagccatgcagagactatgcatgtggataaaccatgggaaaaagcaaaagcagcagcaagttactaatgttattctgaactgcagggagagaatttggcaaataactggtacttaaggctaaaataattgttatttcttttgctttcaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagtta

SEQ ID NO: 287045 - DNA, 5541 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccatgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttattttgctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacaaaactgcaacagccaccccaactttcaagcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagcccgggcgtggtggcgcatgcctgtaattccagctacttgggaggctgagacgggaccattgcctgaacccggtcggcggaggtttctgtgagtggagactgcaccattgcactcaagcctgggcaacacagaatgaaactgtctccaaaataaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcgggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagctcttgtcagggggggcatactattaccttgcgaacc

SEQ ID NO: 287046 - DNA, 1863 bp, Homo sapiens
atggaactgccggaattcgttacgaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagtta

SEQ ID NO: 287047 - DNA, 2096 bp, Homo sapiens
cattctgaattcttggagccaaggtcacaaagggaaatcctgtgaatggcataattttatattctgcataaagtgagtttacacaatgagtgcaacctaatacaacagcaagaaaaaataagaactagtaagcaattgggcaatatgtataatttacatatttatctttaatctgtattatctacactttgatcttttttggttaaagaagtattaataaggaacctacctacaaatgtagtctgtttcacaacataattactgatagcccattataaccaattttaaaatccttaaaataattactgatagcccattataaccaattttaaaatccttaaaataattactgatagcccattataactgattttaaaatccttaaaaatcatttcatttttcagttacttataaaactttttcttgatctttcagacctactttgaagaaaagttgatctgtctctgtattaccattttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagtta

SEQ ID NO: 287048 - DNA, 5290 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccatgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttattttgctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacaaaactgcaacagccaccccaactttcaagcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagcccgggcgtggtggcgcatgcctgtaattccagctacttgggaggctgagacgggaccattgcctgaacccggtcggcggaggtttctgtgagtggagactgcaccattgcactcaagcctgggcaacacagaatgaaactgtctccaaaataaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcgggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgattcgcgcatgggatcctctagt

SEQ ID NO: 287049 - DNA, 1166 bp, Homo sapiens
aacaaaacatcttactcctagctataaccacacacctctcaacgcacactgaacatctttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagtta

SEQ ID NO: 287050 - DNA, 5368 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccatgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttattttgctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacaaaactgcaacagccaccccaactttcaagcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagcccgggcgtggtggcgcatgcctgtaattccagctacttgggaggctgagacgggaccattgcctgaacccggtcggcggaggtttctgtgagtggagactgcaccattgcactcaagcctgggcaacacagaatgaaactgtctccaaaataaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcgggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagctcttgtcagggggggcatactattaccttgcgaacc

SEQ ID NO: 287051 - DNA, 5060 bp, Homo sapiens
  misc_feature (5015)..(5015): n is a, c, g, or t
  misc_feature (5057)..(5057): n is a, c, g, or t
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccatgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttattttgctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacaaaactgcaacagccaccccaactttcaagcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagcccgggcgtggtggcgcatgcctgtaattccagctacttgggaggctgagacgggaccattgcctgaacccggtcggcggaggtttctgtgagtggagactgcaccattgcactcaagcctgggcaacacagaatgaaactgtctccaaaataaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcgggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttatgcgcgacttcncttaatggtggctaatcttgatcgttgtgaccagagttacgngtg

SEQ ID NO: 287052 - DNA, 2963 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccatgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttattttgctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacagtatgtgctcacttcatgtctctctcacattttggtaattcttggaatgtttccgttattaaatcagttatagtgatctgtgattagtgatctttgatattactgtcataattgcttggggggcaccatgaaccacccctatataagacagcaaactgagtcgataaatgttttatgtgttctgaccactgcactgaccagctgcctccctatctctctccttctgctcagacctccctatccttgagacacagcaatactgaaattaggggccaggcatggtggtggctcatgcctgtagtcccagctacttgggagactgaagcaggaggattgcttgagcctaggagttcgaggctgcagtgagctgtgatcacgccactgcacttcagcatgggcagcaaagcaagaccctgactc

SEQ ID NO: 287053 - DNA, 5538 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccatgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttattttgctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacaaaactgcaacagccaccccaactttcaagcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagcccgggcgtggtggcgcatgcctgtaattccagctacttgggaggctgagacgggaccattgcctgaacccggtcggcggaggtttctgtgagtggagactgcaccattgcactcaagcctgggcaacacagaatgaaactgtctccaaaataaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcgggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcaggtactgtggacgggcggcggagttcgggagacaggggcagggcggcatcggggagctgcgggacggggcggggaggaggcccgaggtctgagccacccgtgaggtctcggcgcggaggcctggacagctgggggtggcggcgttggtctcccgaactggagggaggccgggccttcccgggctgtggtgggcgcccgcgccccgtggaaggcggaggcgtgagtcggggcgtcagagacgttgccattctttgtcagcggaaaagatcgtcgtctgcgcacagtcacctgaggtttaggaactcgtggaactggaaaccgagtcgcaggagactaagagttgcgagtctccccttagagaattcagaaacaagcgtagacagcatcgtcagaaacacgagcgtgacgacaccggcctccccgtgccgagtccacgcgtgtgacgcgggtgcatacacctgcgtccgtgcaagagggtgacagcaacacactcaaggcgcttctcctgggaatggagcaggagaagagatggggagcatcgcatagatggaactagacctttttcttgggttggatgatgtgttcccgcgtctactacatggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggtaaccagctctcctacacaaccatacaagctgaaacctaaacatactataaaaaggtttttaataaaatttttaaattcaaatgtagttctctgcttggtaacctccggagttatgagttagccccacaaaccatcttgaataaagattatttaaatttt

SEQ ID NO: 287054 - DNA, 3440 bp, Homo sapiens
acgcccggcttccgccccgcagccccgaggggtctgggcgcgctgaagaccccttcggctgctgggccaacgcccccacccttggtcacctactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccatgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttattttgctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacaaaactgcaacagccaccccaactttcaagcaccaccttgatcaacagccatcaacattgaggcaaaaccctccaccagcaaaaagattatgactcattgaaggctcagctgatggttagcagtaaaaaatattaactttaatcatctcgaccattcagtactcatctaatattctctataacaaaatgggaaatgcacataaagcacttctgctacatgctgaattatgattgttgtctccaggaaaagaacttgtgggaacgtttgagttgtaagctgaactaactagctgcttttttcatgaaataccgcttttactggaaagaactgacagataaactgaggtattcaaacctagatatttggcagacattttcgtgaaaataaatatgttcgtgccacttcaaggaacataattctcagtacttgttgccaataatgttggaattttcatgcaaaaattcaaataaaaaacaaacttaaaaccatcaagaacttggtgactttatgtggaagccagtgctacaatactttagcttcccaatacttaaaaacttttctgatgagattactagtgatattaacaatgtgattgatattgaataatgaaatgttttagcatttggaagatctgtttaattcagtaaatcagtattttccaaatgaccaatgcatgacatttcaacatcacgcacaggaaaataggcattcgaggtacagtcaaaaataatgagttttaatgtaacaagtacaaaatgtccattgaagtggtttcaaattccaaatagtaattggaaaatccaccactcgtgttttggggtagtagtatcgaaaaagaataaccaagataatttgaaaaggctattaaaaaatacttctcaattttcaaactgcata

SEQ ID NO: 287055 - DNA, 294 bp, Homo sapiens
actcgatccgctgatcagcatggttcatgacacctaagtgtcatatacaagtcctattcacagcgtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagtta

SEQ ID NO: 287056 - DNA, 317 bp, Homo sapiens
attacacaggacaggcatgtgaagacacagcaagaggtctgcagccaaggagagtaggcttacgtagataagctaaccctgtaggcatattcatcttggacttccagcctccagaacagtgagaacaataaatatttgataagccaactagaggaactactgtacaaaaatttaaagaaatggtctatagtctctttaaggtaagcatacccattcatatgttgctagtgtgaagtgggactctttagaggaattggcaggacctcatcctaagccattaaagtgttgatattctttgacctctatcagattctcca

SEQ ID NO: 287057 - DNA, 4710 bp, Homo sapiens
  misc_feature (3798)..(3798): n is a, c, g, or t
  misc_feature (3950)..(3950): n is a, c, g, or t
  misc_feature (4418)..(4418): n is a, c, g, or t
gggcggggagcccggccgccagcgctcgggtccgcctctgactgcagcgcggcggggcgatgtgtgattaccatggcgaggagtctctgtccgggggcctggctaaggaaaccctattacctccaggctcgcttctcatatgtgcggatgaaatatcttttcttttcctggttagtggtttttgttggaagctggattatatatgtgcagtattctacctatacagaattatgcagaggaaaggactgtaagaaaataatatgtgacaagtacaagactggagttattgatgggcctgcatgtaacagcctttgtgttacagaaactctttactttggaaaatgtttatccaccaagcccaacaatcagatgtatttagggatttgggataatctaccaggtgttgtgaaatgtcaaatggaacaagcgcttcatcttgattttggaactgaattggaaccaagaaaagaaatagtgctatttgataagccaactagaggaactactgtacaaaaatttaaagaaatggtctatagtctctttaaggcaaaattgggtgaccaaggaaacctctctgaactggttaatctcatcttgacggtggctgatggagacaaagatggccaggtttccttgggagaagcaaagtcggcatgggcacttcttcaactgaatgaatttcttctcatggtgatacttcaagataaagaacatacccccaaattaatgggattctgtggtgacctctatgtgatggaaagtgttgaatatacctctctttatggaataagccttccttgggtcattgaactttttattccatctgggttcagaagaagcatggatcagctgttcacaccatcatggccaagaaaggccaaaatagccataggacttctagaatttgtggaagatgttttccatggcccctacggaaatttcctcatgtgcgatactagtgccaaaaacctaggatataatgataagtatgatttgaaaatggtggatatgagaaaaattgtgccagagacaaacctgaaagaacttattaaggatcgtcactgtgagtctgatttggactgtgtctatggcacagattgtagaactagctgtgatcagagtacaatgaagtgtacttcagaagtgatacaaccaaacttggcaaaagcttgtcagttactcaaagactacctactgcgtggtgctccaagtgaaattcgtgaagaattagaaaagcagctttattcttgtattgctctcaaagtcacagcaaatcaaatggaaatggaacattctttgatactaaataacctaaaaacattattgtggaagaaaatttcctacactaatgactcttagttcatttggacataattaccattttaagaaacctgccacttttaaagaacaattttgagcattaaaaaaaaatggcttcaaattcctgccagttacacaaaactccttccccccaggcctgagaagccatcagtatgtgattactgaagtaatggcaggtgtaggatcaacaggtccccaagatgtcattcctgcccttttagaagccctgttacatctccgaagtacattcattgtgtaactattttgactgactttaaaaaccaatgctgtgaaaagcttcattccataaacatcaacagtgagtgatttgtagatttaccttagccaaaataccaatgctggaagcattgtgtttgcattgaagctgctgttcaacaagaaaatttataaatttactaatgtcttagcatggtaaagtttgcacattaacagaaattaagactgcaaagcaggttaaacttgcttctttataaaacagatgttgggttaatagcatggtttactgtattaaagacttatacacccatttttaacctcattcagacatcaagttatgtgtagcttcacaatggttcaagtggcttacttcaagaaatcttatacttgacagtacaccaattttattgactaaaaatggatgaactttcctaaagattcaaagggcccatcttagtatcacgcagctgactgagcccttcaaaactgacatcttaaggcccaatcaagatccacatatcctgattttgaactatgtgaaagtgggactgttaagtgcaagactaaaataaattatagcagactttttagtaataactttccattttcaaacagtatatcctgtgggccaaagggctatttcttaaagaggcatgtaaatgtatttatttatctaatgtttttttccccatgtaaacttgatatacaaggtttagtatttgctcctctttcatattattttcacacgtatactcagatttggcatgtacctttcaacatctccataaaattaaacaccttttggagaaaagatccactattttctgctcaaaggtttcgcctacctaaagtggaacatgttaaaaatctatgtgaccatcactggacagctttctctcaaaactttccttcaacgccatggattagcaccagttttgtttactttaaggtacttttcccattcatcatctggttataataaatggatggaagaatatttcccactgatggttggtctgttgcttgccaaatttttagggagagctgttcatcatacaacataagggataatgactcctgtcaggtaaaacagaagcccaagaaataacaactttttttcttaaaaagttagttacacttgttttcttggagaaaaaaacctgtcaactcctttgcttttccaaaatatttcagggtatttcctataaggttcataagaataagagcttaacacagaaatagttgctgttcataagtttattatctatatctgaaaaaatcatagaaaattgctgggtttagctctcagcagcccgctcctgagctctgaggaagcttgccttcttttgagctacccgatccttcttctgagcaagggacattttgggacggttccacctacaaaagataggaatatatattttttaaactataactgaagagaatagaatatttaatttaaaattttaataaaatttaattttgatagagaatatttaagactttgcaatcagaaggttaaataatccaagttcaaatacatttacttatgtatgatcttaagctaactttcccaaaccccaacttctgtgatgtcctactaccatagggccaaaagtcaaatagaagacatgttagattcagtaataccacttctaggtatttgcccaaatgttttgaaatcagtttgtccaagagagtggcactcccatgttcattgcagcactatatattaatagcaacagataaatggataaaggaaatgtggtatacatatacataatggattattacccagtctttaaaaatgatggaaattctgtcatttgcaacatgaatgaagtggagaatattgtgctcagtgaaataagccaggcacaaaaagacaaatacttcatattcatatagaatctaaaacaatggaactcacagaagcagagagcagaatggtggttacagaggctggtgggtgcaaagaatgggcagatgatagtcaagtataaaatctccaacaggaggagtatgattttgtttttagttctattgcacagcatgatgaatatagaatatcgtacatttcacaattaagagaataaatttcaaatgttgttgccacaaagtgttaagtatttgaggtgaatatgttaaatacattgatttaattactatacattgtatttgtgggccatcacatcactttatgcttacatgttcattaantattactttctattccatttaaagattcaaaacatgaaaattcaacaaaaagcaacttgtcagccaataaaaaaatgcagtaaccagtacttagactgtactaagatagaaagaaccacctccgttatgtctgaggctaacacattccatcnccacagttacttttgcaaacctggttcccttcgcttctgccacatcacgcagagctagtgatcgagtttgcacaattacaccaacagtctgccccacgtgggaaccattcccaacctgttttcttgaaaagacaaaaaaaaagacgacatacctcttctttttaacttctttcttgggcttcttttcatagactggattctctcgtatagcagcatgagctttcttatacatctcctccatctgaaacaaaggaaagcaaacagtacttggtttcatttcatgtgccctactatattaatgcaaccataacttatcttgtccttctaagccagattctcaaaaggaactaaactaaatcaatgttggtaaacactttaacttctaaatgtaactcaccttttcctaacaaattcccaattttcaccttatgcaatgtgaattatcactacagaactccatcttactcnagaaaaaatcaggccagtgtggtggttcatgcctgtatctcagcactttgggagtctgaagtgggaggatcacttcagcccaggagtttgagaccagctaagcaacacagtgagacctgtctccataaaaaaactaattagccaggtggcaattattaatggtggcatgcacctgtagtcccagctacaggactacacgtgagtccaggaggtcaaggctgcagtggcacaatcacagctcactggaccccagcctagatgacagaatgagacctcatctctaccaaaaatt

SEQ ID NO: 287058 - DNA, 4533 bp, Homo sapiens
  misc_feature (3621)..(3621): n is a, c, g, or t
  misc_feature (3773)..(3773): n is a, c, g, or t
  misc_feature (4241)..(4241): n is a, c, g, or t
gggcggggagcccggccgccagcgctcgggtccgcctctgactgcagcgcggcggggcgatgtgtgattaccatggcgaggagtctctgtccgggggcctggctaaggaaaccctattacctccaggctcgcttctcatatgtgcggatgaaatatcttttcttttcctggttagtggtttttgttggaagctggattatatatgtgcagtattctacctatacagaattatgcagaggaaaggactgtaagaaaataatatgtgacaagtacaagactggagttattgatgggcctgcatgtaacagcctttgtgttacagaaactctttactttggaaaatgtttatccaccaagcccaacaatcaggcaaaattgggtgaccaaggaaacctctctgaactggttaatctcatcttgacggtggctgatggagacaaagatggccaggtttccttgggagaagcaaagtcggcatgggcacttcttcaactgaatgaatttcttctcatggtgatacttcaagataaagaacatacccccaaattaatgggattctgtggtgacctctatgtgatggaaagtgttgaatatacctctctttatggaataagccttccttgggtcattgaactttttattccatctgggttcagaagaagcatggatcagctgttcacaccatcatggccaagaaaggccaaaatagccataggacttctagaatttgtggaagatgttttccatggcccctacggaaatttcctcatgtgcgatactagtgccaaaaacctaggatataatgataagtatgatttgaaaatggtggatatgagaaaaattgtgccagagacaaacctgaaagaacttattaaggatcgtcactgtgagtctgatttggactgtgtctatggcacagattgtagaactagctgtgatcagagtacaatgaagtgtacttcagaagtgatacaaccaaacttggcaaaagcttgtcagttactcaaagactacctactgcgtggtgctccaagtgaaattcgtgaagaattagaaaagcagctttattcttgtattgctctcaaagtcacagcaaatcaaatggaaatggaacattctttgatactaaataacctaaaaacattattgtggaagaaaatttcctacactaatgactcttagttcatttggacataattaccattttaagaaacctgccacttttaaagaacaattttgagcattaaaaaaaaatggcttcaaattcctgccagttacacaaaactccttccccccaggcctgagaagccatcagtatgtgattactgaagtaatggcaggtgtaggatcaacaggtccccaagatgtcattcctgcccttttagaagccctgttacatctccgaagtacattcattgtgtaactattttgactgactttaaaaaccaatgctgtgaaaagcttcattccataaacatcaacagtgagtgatttgtagatttaccttagccaaaataccaatgctggaagcattgtgtttgcattgaagctgctgttcaacaagaaaatttataaatttactaatgtcttagcatggtaaagtttgcacattaacagaaattaagactgcaaagcaggttaaacttgcttctttataaaacagatgttgggttaatagcatggtttactgtattaaagacttatacacccatttttaacctcattcagacatcaagttatgtgtagcttcacaatggttcaagtggcttacttcaagaaatcttatacttgacagtacaccaattttattgactaaaaatggatgaactttcctaaagattcaaagggcccatcttagtatcacgcagctgactgagcccttcaaaactgacatcttaaggcccaatcaagatccacatatcctgattttgaactatgtgaaagtgggactgttaagtgcaagactaaaataaattatagcagactttttagtaataactttccattttcaaacagtatatcctgtgggccaaagggctatttcttaaagaggcatgtaaatgtatttatttatctaatgtttttttccccatgtaaacttgatatacaaggtttagtatttgctcctctttcatattattttcacacgtatactcagatttggcatgtacctttcaacatctccataaaattaaacaccttttggagaaaagatccactattttctgctcaaaggtttcgcctacctaaagtggaacatgttaaaaatctatgtgaccatcactggacagctttctctcaaaactttccttcaacgccatggattagcaccagttttgtttactttaaggtacttttcccattcatcatctggttataataaatggatggaagaatatttcccactgatggttggtctgttgcttgccaaatttttagggagagctgttcatcatacaacataagggataatgactcctgtcaggtaaaacagaagcccaagaaataacaactttttttcttaaaaagttagttacacttgttttcttggagaaaaaaacctgtcaactcctttgcttttccaaaatatttcagggtatttcctataaggttcataagaataagagcttaacacagaaatagttgctgttcataagtttattatctatatctgaaaaaatcatagaaaattgctgggtttagctctcagcagcccgctcctgagctctgaggaagcttgccttcttttgagctacccgatccttcttctgagcaagggacattttgggacggttccacctacaaaagataggaatatatattttttaaactataactgaagagaatagaatatttaatttaaaattttaataaaatttaattttgatagagaatatttaagactttgcaatcagaaggttaaataatccaagttcaaatacatttacttatgtatgatcttaagctaactttcccaaaccccaacttctgtgatgtcctactaccatagggccaaaagtcaaatagaagacatgttagattcagtaataccacttctaggtatttgcccaaatgttttgaaatcagtttgtccaagagagtggcactcccatgttcattgcagcactatatattaatagcaacagataaatggataaaggaaatgtggtatacatatacataatggattattacccagtctttaaaaatgatggaaattctgtcatttgcaacatgaatgaagtggagaatattgtgctcagtgaaataagccaggcacaaaaagacaaatacttcatattcatatagaatctaaaacaatggaactcacagaagcagagagcagaatggtggttacagaggctggtgggtgcaaagaatgggcagatgatagtcaagtataaaatctccaacaggaggagtatgattttgtttttagttctattgcacagcatgatgaatatagaatatcgtacatttcacaattaagagaataaatttcaaatgttgttgccacaaagtgttaagtatttgaggtgaatatgttaaatacattgatttaattactatacattgtatttgtgggccatcacatcactttatgcttacatgttcattaantattactttctattccatttaaagattcaaaacatgaaaattcaacaaaaagcaacttgtcagccaataaaaaaatgcagtaaccagtacttagactgtactaagatagaaagaaccacctccgttatgtctgaggctaacacattccatcnccacagttacttttgcaaacctggttcccttcgcttctgccacatcacgcagagctagtgatcgagtttgcacaattacaccaacagtctgccccacgtgggaaccattcccaacctgttttcttgaaaagacaaaaaaaaagacgacatacctcttctttttaacttctttcttgggcttcttttcatagactggattctctcgtatagcagcatgagctttcttatacatctcctccatctgaaacaaaggaaagcaaacagtacttggtttcatttcatgtgccctactatattaatgcaaccataacttatcttgtccttctaagccagattctcaaaaggaactaaactaaatcaatgttggtaaacactttaacttctaaatgtaactcaccttttcctaacaaattcccaattttcaccttatgcaatgtgaattatcactacagaactccatcttactcnagaaaaaatcaggccagtgtggtggttcatgcctgtatctcagcactttgggagtctgaagtgggaggatcacttcagcccaggagtttgagaccagctaagcaacacagtgagacctgtctccataaaaaaactaattagccaggtggcaattattaatggtggcatgcacctgtagtcccagctacaggactacacgtgagtccaggaggtcaaggctgcagtggcacaatcacagctcactggaccccagcctagatgacagaatgagacctcatctctaccaaaaatt

SEQ ID NO: 287059 - DNA, 2573 bp, Homo sapiens
gggcggggagcccggccgccagcgctcgggtccgcctctgactgcagcgcggcggggcgatgtgtgattaccatggcgaggagtctctgtccgggggcctggctaaggaaaccctattacctccaggctcgcttctcatatgtgcggatgaaatatcttttcttttcctggttagtggtttttgttggaagctggattatatatgtgcagtattctacctatacagaattatgcagaggaaaggactgtaagaaaataatatgtgacaagtacaagactggagttattgatgggcctgcatgtaacagcctttgtgttacagaaactctttactttggaaaatgtttatccaccaagcccaacaatcagatgtatttagggatttgggataatctaccaggtgttgtgaaatgtcaaatggaacaagcgcttcatcttgattttggaactgaattggaaccaagaaaagaaatagtgctatttgataagccaactagaggaactactgtacaaaaatttaaagaaatggtctatagtctctttaaggcaaaattgggtgaccaaggaaacctctctgaactggttaatctcatcttgacggtggctgatggagacaaagatggccaggtttccttgggagaagcaaagtcggcatgggcacttcttcaactgaatgaatttcttctcatggtgatacttcaagataaagaacatacccccaaattaatgggattctgtggtgacctctatgtgatggaaagtgttgaatatacctctctttatggaataagccttccttgggtcattgaactttttattccatctgggttcagaagaagcatggatcagctgttcacaccatcatggccaagaaaggccaaaatagccataggacttctagaatttgtggaagatgttttccatggcccctacggaaatttcctcatgtgcgatactagtgccaaaaacctaggatataatgataagtatgatttgaaaatggtggatatgagaaaaattgtgccagagacaaacctgaaagaacttattaaggatcgtcactgtgagtctgatttggactgtgtctatggcacagattgtagaactagctgtgatcagagtacaatgaagtgtacttcagaagtgatacaaccaaacttggcaaaagcttgtcagttactcaaagactacctactgcgtggtgctccaagtgaaattcgtgaagaattagaaaagcagctttattcttgtattgctctcaaagtcacagcaaatcaaatggaaatggaacattctttgatactaaataacctaaaaacattattgtggaagaaaatttcctacactaatgactcttagttcatttggacataattaccattttaagaaacctgccacttttaaagaacaattttgagcattaaaaaaaaatggcttcaaattcctgccagttacacaaaactccttccccccaggcctgagaagccatcagtatgtgattactgaagtaatggcaggtgtaggatcaacaggtccccaagatgtcattcctgcccttttagaagccctgttacatctccgaagtacattcattgtgtaactattttgactgactttaaaaaccaatgctgtgaaaagcttcattccataaacatcaacagtgagtgatttgtagatttaccttagccaaaataccaatgctggaagcattgtgtttgcattgaagctgctgttcaacaagaaaatttataaatttactaatgtcttagcatggtaaagtttgcacattaacagaaattaagactgcaaagcaggttaaacttgcttctttataaaacagatgttgggttaatagcatggtttactgtattaaagacttatacacccatttttaacctcattcagacatcaagttatgtgtagcttcacaatggttcaagtggcttacttcaagaaatcttatacttgacagtacaccaattttattgactaaaaatggatgaactttcctaaagattcaaagggcccatcttagtatcacgcagctgactgagcccttcaaaactgacatcttaaggcccaatcaagatccacatatcctgattttgaactatgtgaaagtgggactgttaagtgcaagactaaaataaattatagcagactttttagtaataactttccattttcaaacagtatatcctgtgggccaaagggctatttcttaaagaggcatgtaaatgtatttatttatctaatgtttttttccccatgtaaacttgatatacaaggtttagtatttgctcctctttcatattattttcacacgtatactcagatttggcatgtacctttcaacatctccataaaattaaacaccttttggagaaaagatccactattttctgctcaaaggtttcgcctacctaaagtggaacatgttaaaaatctatgtgaccatcactggacagctttctctcaaaactttccttcaacgccatggattagcaccagttttgtttactttaaggtacttttcccattcatcatctggttataataaatggatggaagaa

SEQ ID NO: 287060 - DNA, 2386 bp, Homo sapiens
gggcggggagcccggccgccagcgctcgggtccgcctctgactgcagcgcggcggggcgatgtgtgattaccatggcgaggagtctctgtccgggggcctggctaaggaaaccctattacctccaggctcgcttctcatatgtgcggatgaaatatcttttcttttcctggttagtggtttttgttggaagctggattatatatgtgcagtattctacctatacagaattatgcagaggaaaggactgtaagaaaataatatgtgacaagtacaagactggagttattgatgggcctgcatgtaacagcctttgtgttacagaaactctttactttggaaaatgtttatccaccaagcccaacaatcagatgtatttagggatttgggataatctaccaggtgttgtgaaatgtcaaatggaacaagcgcttcatcttgattttggaactgaattggaaccaagaaaagaaatagtgctatttgataagccaactagaggaactactgtacaaaaatttaaagaaatggtctatagtctctttaaggcaaaattgggtgaccaaggaaacctctctgaactggttaatctcatcttgacggtggctgatggagacaaagatggccaggtttccttgggagaagcaaagtcggcatgggcacttcttcaactgaatgaatttcttctcatggtgatacttcaagataaagaacatacccccaaattaatgggattctgtggtgacctctatgtgatggaaagtgttgaatatacctctctttatggaataagccttccttgggtcattgaactttttattccatctgggttcagaagaagcatggatcagctgttcacaccatcatggccaagaaaggccaaaatagccataggacttctagaatttgtggaagatgttttccatggcccctacggaaatttcctcatgtgcgatactagtgccaaaaacctaggatataatgataagtatgatttgaaaatggtggatatgagaaaaattgtgccagagacaaacctgaaagaacttattaaggatcgtcactgtgagtctgatttggactgtgtctatggcacagattgtagaactagctgtgatcagagtacaatgaagtgtacttcagaagtgatacaaccaaacttggcaaaagcttgtcagttactcaaagactacctactgcgtggtgctccaagtgaaattcgtgaagaattagaaaagcagctttattcttgtattgctctcaaagtcacagcaaatcaaatggaaatggaacattctttgatactaaataacctaaaaacattattgtggaagaaaatttcctacactaatgactcttagttcatttggacataattaccattttaagaaacctgccacttttaaagaacaattttgagcattaaaaaaaaatggcttcaaattcctgccagttacacaaaactccttccccccaggcctgagaagccatcagtatgtgattactgaagtaatggcaggtgtaggatcaacaggtccccaagatgtcattcctgcccttttagaagccctgttacatctccgaagtacattcattgtgtaactattttgactgactttaaaaaccaatgctgtgaaaagcttcattccataaacatcaacagtgagtgatttgtagatttaccttagccaaaataccaatgctggaagcattgtgtttgcattgaagctgctgttcaacaagaaaatttataaatttactaatgtcttagcatggtaaagtttgcacattaacagaaattaagactgcaaagcaggttaaacttgcttctttataaaacagatgttgggttaatagcatggtttactgtattaaagacttatacacccatttttaacctcattcagacatcaagttatgtgtagcttcacaatggttcaagtggcttacttcaagaaatcttatacttgacagtacaccaattttattgactaaaaatggatgaactttcctaaagattcaaagggcccatcttagtatcacgcagctgactgagcccttcaaaactgacatcttaaggcccaatcaagatccacatatcctgattttgaactatgtgaaagtgggactgttaagtgcaagactaaaataaattatagcagactttttagtaataactttccattttcaaacagtatatcctgtgggccaaagggctatttcttaaagaggcatgtaaatgtatttatttatctaatgtttttttccccatgtaaacttgatatacaaggtttagtatttgctcctctttcatattattttcacacgtatactcagatttggcatgtacctttcaacatctccataaaattaaacaccttttggaga

SEQ ID NO: 287061 - DNA, 2174 bp, Homo sapiens
gggcggggagcccggccgccagcgctcgggtccgcctctgactgcagcgcggcggggcgatgtgtgattaccatggcgaggagtctctgtccgggggcctggctaaggaaaccctattacctccaggctcgcttctcatatgtgcggatgaaatatcttttcttttcctggttagtggtttttgttggaagctggattatatatgtgcagtattctacctatacagaattatgcagaggaaaggactgtaagaaaataatatgtgacaagtacaagactggagttattgatgggcctgcatgtaacagcctttgtgttacagaaactctttactttggaaaatgtttatccaccaagcccaacaatcagatgtatttagggatttgggataatctaccaggtgttgtgaaatgtcaaatggaacaagcgcttcatcttgattttggaactgaattggaaccaagaaaagaaatagtgctatttgataagccaactagaggaactactgtacaaaaatttaaagaaatggtctatagtctctttaaggcaaaattgggtgaccaaggaaacctctctgaactggttaatctcatcttgacggtggctgatggagacaaagatggccaggtttccttgggagaagcaaagtcggcatgggcacttcttcaactgaatgaatttcttctcatggtgatacttcaagataaagaacatacccccaaattaatgggattctgtggtgacctctatgtgatggaaagtgttgaatatacctctctttatggaataagccttccttgggtcattgaactttttattccatctgggttcagaagaagcatggatcagctgttcacaccatcatggccaagaaaggccaaaatagccataggacttctagaatttgtggaagatgttttccatggcccctacggaaatttcctcatgtgcgatactagtgccaaaaacctaggatataatgataagtatgatttgaaaatggtggatatgagaaaaattgtgccagagacaaacctgaaagaacttattaaggatcgtcactgtgagtctgatttggactgtgtctatggcacagattgtagaactagctgtgatcagagtacaatgaagtgtacttcagaagtgatacaaccaaacttggcaaaagcttgtcagttactcaaagactacctactgcgtggtgctccaagtgaaattcgtgaagaattagaaaagcagctttattcttgtattgctctcaaagtcacagcaaatcaaatggaaatggaacattctttgatactaaataacctaaaaacattattgtggaagaaaatttcctacactaatgactcttagttcatttggacataattaccattttaagaaacctgccacttttaaagaacaattttgagcattaaaaaaaaatggcttcaaattcctgccagttacacaaaactccttccccccaggcctgagaagccatcagtatgtgattactgaagtaatggcaggtgtaggatcaacaggtccccaagatgtcattcctgcccttttagaagccctgttacatctccgaagtacattcattgtgtaactattttgactgactttaaaaaccaatgctgtgaaaagcttcattccataaacatcaacagtgagtgatttgtagatttaccttagccaaaataccaatgctggaagcattgtgtttgcattgaagctgctgttcaacaagaaaatttataaatttactaatgtcttagcatggtaaagtttgcacattaacagaaattaagactgcaaagcaggttaaacttgcttctttataaaacagatgttgggttaatagcatggtttactgtattaaagacttatacacccatttttaacctcattcagacatcaagttatgtgtagcttcacaatggttcaagtggcttacttcaagaaatcttatacttgacagtacaccaattttattgactaaaaatggatgaactttcctaaagattcaaagggcccatcttagtatcacgcagctgactgagcccttcaaaactgacatcttaaggcccaatcaagatccacatatcctgattttgaactatgtgaaagtgggactgttaagtgcaagactaaaataaattatagcagactttttagtaata

SEQ ID NO: 287062 - DNA, 2253 bp, Homo sapiens
ttggtgaagaaaagcaaaagtgcagaaaaccatcttttcgaaagagctttccatcattcaggcaacaggtcactcagtgaagaaactgtgccaggagactgggaatatcttctaaatccttaagcaaactgtgctgaaaacaaactgctgaaagaaaataagcatttgactttaaaacgatgcctctggaaaaaagggacatgcagcagctgccagatgttcatgatcccacctcccctacttaacaaaggcacctatatttcaccagaaataaaattttattagtaacatgtcaaatgttttaaaatacaattacctttcttcttcctctcagtttaaaaaacaatccaataaaaactctaaatcatgacccaaatatttttaaatgtgaaaaagacatatttcagattatgtaacagatacacattttcccaaataaatgttgtagaacaccatctgcttgatatttgagtgcattcccacagaaataaatttctgcttctcttccttcattaatggcttatgacaaatttatgacactatatttcacaatagctataccaaaattttatgaccaaaagaggctgacaaaaatcacttggcatgctcaaattagacaatttatgtgactgtctcatttacaccaatcctccaccccttactgagaccccagcgactgaggagaaacagaaaaaatcactgtaggggaagatctctcacagaataaagctcaaaaaagagttcaagacaagaagttacagatccaggtgccattttcagctcaggttttccataatcttcagcttatgcagctacccaaaattctgaatttaatgtaggatgtttttgtaaggttgtctcagaatttgccaagcaagaagttgctaattcttgtaactgtgaacagaatttcatctttgttaccaaatggagctcccttatgtgagtataatcaagaggaaaatcaagaagagaaatttaccacgtgtcatctcctgactgataagaatggtacaagactctacccatgttcctttcctgcacttgatacagagaaaacttgtaacaggaataatctttgcattttactctacagagtattacagtatttgtggcaaatttggaaaaccagtgttatggttttctgattttactttatgcagtttatttcttaaaagaaaaaattcttgcagaacacagacatgaacacagagtctttgaaagtttaagagtataggcttcagtgtggatatttctcaaaagatgtagaatctcccaactcaaagtgtggtcgatggactggcagcatccacatcacctgggagatttgagagatgaagaccttcattcctcatcccaaacctactaaaaggaatctgtattttcacaagatccctagtgacttgtatgctcaagaagcactaatgtaatgtttttaatccacccaaccctaaaggataatccttgagaaagacaaaactactttaatggggaaattttgtccataatattcaaccaggaatgtaacaacttttagacatggcccacttaataaaaaaacaaaaaacctgaaatttatcttgttgctgctgtatagtaatgaagtatgagaatgggaacatataaattaaaatgccatatgttaaataaatattcatgacctgattgaattaattatacacaaccttccattgtttccaacctaagtagtttcttttgtgagacatatacagctgttaactattacactgaattccagaaacatgaaaattgccttagtaaacaattatttaatgactaagtacaatagtctcaaaaagaattttgttcagccagtaacgaccatgttactatgatgaattcttatttgatacactccagaaactttcccaaaggagttcagccagtactgcaaattgttactttcttctaagtatcaatgatagggagcaaggtgtgggtgaagaatagagctataacttccacttacaatggactataaagactggggtcaggctgtgatttaaagaggaaaccagagggagagaaagaaggtgggctccagtacctggtgttaagaaataccgaagttcattcaagcaattcaccagcacaaggcaaattgaagaagactgcccctctgagcttgcacacaacatacacaactttcaggctgtgatttattgattctctttctcctttaaagctctccttaacattagtattaatctgatttgttccataaaagaacat

SEQ ID NO: 287063 - DNA, 2199 bp, Homo sapiens
ttggtgaagaaaagcaaaagtgcagaaaaccatcttttcgaaagagctttccatcattcaggcaacaggtcactcagtgaagaaactgtgccaggagactgggaatatcttctaaatccttaagcaaactgtgctgaaaacaaactgctgaaagaaaataagcatttgactttaaaacgatgcctctggaaaaaagggacatgcagcagctgccagatgttcatgatcccacctcccctacttaacaaaggcacctatatttcaccagaaataaaattttattagtaacatgtcaaatgttttaaaatacaattacctttcttcttcctctcagtttaaaaaacaatccaataaaaactctaaatcatgacccaaatatttttaaatgtgaaaaagacatatttcagattatgtaacagatacacattttcccaaataaatgttgtagaacaccatctgcttgatatttgagtgcattcccacagaaataaatttctgcttctcttccttcattaatggcttatgacaaatttatgacactatatttcacaatagctataccaaaattttatgaccaaaagaggctgacaaaaatcacttggcatgctcaaattagacaatttatgtgactgtctcatttacaccaatcctccaccccttactgagaccccagcgactgaggagaaacagaaaaaatcactgtaggggaagatctctcacagaataaagctcaaaaaagagttcaagacaagaagttacagatccaggtgccattttcagctcaggttttccataatcttcagcttatgcagctacccaaaattctgaatttaatgtaggatgtttttgtaaggttgtctcagaatttgccaagcaagaagttgctaattcttgtaactgtgaacagaatttcatctttgttaccaaatggagctcccttatgtgagtataatcaagaggaaaatcaagaagagaaatttaccacgtgtcatctcctgactgataagaatggtacaagactctacccatgttcctttcctgcacttgatacagagaaaacttgtaacaggaataatctttgcattttactctacagagtattacagtatttgtggcaaatttggaaaaccagtgttatggttttctgattttactttatgcagtttatttcttaaaagaaaaaattcttgcagaacacagacatgaacacagagtctttgaaagtttaagagtataggcttcagtgtggatatttctcaaaagatgtagaatctcccaactcaaagtgtggtcgatggactggcagcatccacatcacctgggagatttgagagatgaagaccttcattcctcatcccaaacctactaaaaggaatctgtattttcacaagatccctagtgacttgtatgctcaagaagcactaatgtaatgtttttaatccacccaaccctaaaggataatccttgagaaagacaaaactactttaatggggaaattttgtccataatattcaaccaggaatgtaacaacttttagacatggcccacttaataaaaaaacaaaaaacctgaaatttatcttgttgctgctgtatagtaatgaagtatgagaatgggaacatataaattaaaatgccatatgttaaataaatattcatgacctgattgaattaattatacacaaccttccattgtttccaacctaagtagtttcttttgtgagacatatacagctgttaactattacactgaattccagaaacatgaaaattgttcagccagtaacgaccatgttactatgatgaattcttatttgatacactccagaaactttcccaaaggagttcagccagtactgcaaattgttactttcttctaagtatcaatgatagggagcaaggtgtgggtgaagaatagagctataacttccacttacaatggactataaagactggggtcaggctgtgatttaaagaggaaaccagagggagagaaagaaggtgggctccagtacctggtgttaagaaataccgaagttcattcaagcaattcaccagcacaaggcaaattgaagaagactgcccctctgagcttgcacacaacatacacaactttcaggctgtgatttattgattctctttctcctttaaagctctccttaacattagtattaatctgatttgttccataaaagaacat

SEQ ID NO: 287064 - DNA, 636 bp, Homo sapiens
gcagttgggaaaagttaattttgataaatgtgtaataaggtgggagaagagttatgaggaatttatataattggatgaaagtaaaggaattaagagtatataagaagattaaggaagtagggattagagaaggataggtgaaagagtagcaggggaagatgaagaaggtgatagtgcaggtggtgaaaaaggttattctgtaattaatggatgatagggaccttggaaagttattaatgttaggcactgcaggaatttgggcagaagcactcaccaggcagtgcccaggaccccaaacatctccccccacttcccagaacataccctcagaacctgggtcttttacctaactatgggggctacgtgccagggtataagttccagtttggccacacatttggccatctcacccatgatgctctgggcctcagcaccttccagaagcagctcttggcttaggccactggacatcaagttcccttcccttttcatcctatcccagccatccttttggaagggagagaggtgggtgggagggtgggagggtgggggaacacaaagagaaaatggtttggaggctgagcaccttttttattaataggtataataaataaataaataaatacataaacagac

SEQ ID NO: 287065 - DNA, 997 bp, Homo sapiens
cagagccttggctcaaaggcaaacaaaaggaaatgcccggctccccatggctgtggccagcaccttcataccagggctcaaccctcagaaccctcattatatcccagggtacactggacactgcccactacttcggttcagcgtgggccagacctatgggcaggtgactggtcagctacttcgaggccctcctggcctagcctggccccctgtccaccgcacacttctgcctcccattcggcctccaagatctcctgaggttcccagggagagtctacctgtcaggcgtgggcaagaaaggctcagctccagcatgatccctgggtacacaggttttgtaccccgggcacagttcatctttgccaagaactgcagccaggtctgggccgaggctctgagtgactttactcacttgcatgagaaggaccaggtgccagagccggaggggcagctggaggagccgacactggaggtggtggaacaagcttctccctactccatggatgacagggaccctcggaagttcttcatgtcaggcttcactggctatgtgccctgcgcccgcttcctcttcggctccagctttcctgtgctcaccaaccaggcactgcaggaatttgggcagaagcactcaccaggcagtgcccaggaccccaaacatctccccccacttcccagaacataccctcagaacctgggtcttttacctaactatgggggctacgtgccagggtataagttccagtttggccacacatttggccatctcacccatgatgctctgggcctcagcaccttccagaagcagctcttggcttaggccactggacatcaagttcccttcccttttcatcctatcccagccatccttttggaagggagagaggtgggtgggagggtgggagggtgggggaacacaaagagaaaatggtttggaggctgagcaccttttttattaataggtataataaataaataaataaatacataaacagac

SEQ ID NO: 287066 - DNA, 1000 bp, Homo sapiens
  misc_feature (903)..(903): n is a, c, g, or t
  misc_feature (984)..(984): n is a, c, g, or t
cagagccttggctcaaaggcaaacaaaaggaaatgcccggctccccatggctgtggccagcaccttcataccagggctcaaccctcagaaccctcattatatcccagggtacactggacactgcccactacttcggttcagcgtgggccagacctatgggcaggtgactggtcagctacttcgaggccctcctggcctagcctggccccctgtccaccgcacacttctgcctcccattcggcctccaagatctcctgaggttcccagggagagtctacctgtcaggcgtgggcaagaaaggctcagctccagcatgatccctgggtacacaggttttgtaccccgggcacagttcatctttgccaagaactgcagccaggtctgggccgaggctctgagtgactttactcacttgcatgagaaggaccaggtgccagagccggaggggcagctggaggagccgacactggaggtggtggaacaagcttctccctactccatggatgacagggaccctcggaagttcttcatgtcaggcttcactggctatgtgccctgcgcccgcttcctcttcggctccagctttcctgtgctcaccaaccaggcactgcaggaatttgggcagaagcactcaccaggcagtgcccaggaccccaaacatctccccccacttcccagaacataccctcagaacctgggtcttttacctaactatgggggctacgtgccagggtataagttccagtttggccacacatttggccatctcacccatgatgctctgggcctcagcaccttccagaagcagctcttggcttaggccactggacatcaagttcccttcccttttcatcctatcccagccatccttttggaagggagagaggtgggtggttttctgcntctccttctttctcttcccctgtgtctttcttcttcctcctttttcgtttctggtgtgttctccttttcctcggttccccncctctttgcctctccg

SEQ ID NO: 287067 - DNA, 773 bp, Homo sapiens
cagagccttggctcaaaggcaaacaaaaggaaatgcccggctccccatggctgtggccagcaccttcataccagggctcaaccctcagaaccctcattatatcccagggttttgtaccccgggcacagttcatctttgccaagaactgcagccaggtctgggccgaggctctgagtgactttactcacttgcatgagaaggaccaggtgccagagccggaggggcagctggaggagccgacactggaggtggtggaacaagcttctccctactccatggatgacagggaccctcggaagttcttcatgtcaggcttcactggctatgtgccctgcgcccgcttcctcttcggctccagctttcctgtgctcaccaaccaggcactgcaggaatttgggcagaagcactcaccaggcagtgcccaggaccccaaacatctccccccacttcccagaacataccctcagaacctgggtcttttacctaactatgggggctacgtgccagggtataagttccagtttggccacacatttggccatctcacccatgatgctctgggcctcagcaccttccagaagcagctcttggcttaggccactggacatcaagttcccttcccttttcatcctatcccagccatccttttggaagggagagaggtgggtgggagggtgggagggtgggggaacacaaagagaaaatggtttggaggctgagcaccttttttattaataggtataataaataaataaataaatacataaacagac

SEQ ID NO: 287068 - DNA, 1228 bp, Homo sapiens
cagagccttggctcaaaggcaaacaaaaggaaatgcccggctccccatggctgtggccagcaccttcataccagggctcaaccctcagaaccctcattatatcccagggtacactggacactgcccactacttcggttcagcgtgggccagacctatgggcaggtgactggtcagctacttcgaggccctcctggcctagcctggccccctgtccaccgcacacttctgcctcccattcggcctccaagatctcctgaggttcccagggagagtctacctgtcaggcgtgggcaagaaaggctcagctccagcatgatccctgggtacacaggttttgtaccccgggcacagttcatctttgccaagaactgcagccaggtctgggccgaggctctgagtgactttactcacttgcatgagaaggaccaggtgccagagccggaggggcagctggaggagccgacactggaggtggtggaacaagcttctccctactccatggatgacagggaccctcggaagttcttcatgtcaggcactgcaggaatttgggcagaagcactcaccaggcagtgcccaggaccccaaacatctccccccacttcccagaacataccctcagaacctgggtcttttacctaactatgggggctacgtgccagggtataagttccagtttggccacacatttggccatctcacccatgatgctctgggcctcagcaccttccagaagcagctcttggcttaggccactggacatcaagttcccttcccttttcatcctatcccagccatccttttggaagggagagaggtgggtgggagggtgggagggtgggggaacacaaagagaaaatggtttggaggctgagcaccttttttatttattcggctgttcctttcctcgcctcgctcttccgctgggctcctgggtctctcgcgttttgcgtctctcgctcctggctcgggccttgctgcgccgtcctgttgctctctgcggcgccccctcctgcgtcgtgccctccctcgctcggctcgctcgctgtgcggtcgttctctcgcttcctctctgtcttgcgctgttggcgcccgttcctgccttgggtctgtcttgctgtcctcctgtgctgccgtgcgccgctctcggctcgctgccttcttcgctcgtcttcggttctgtcctcccgggctgtgccgtttcctgtcgttctcttgcgctccccg

SEQ ID NO: 287069 - DNA, 972 bp, Homo sapiens
cagagccttggctcaaaggcaaacaaaaggaaatgcccggctccccatggctgtggccagcaccttcataccagggctcaaccctcagaaccctcattatatcccaggcgtgggccagacctatgggcaggtgactggtcagctacttcgaggccctcctggcctagcctggccccctgtccaccgcacacttctgcctcccattcggcctccaagatctcctgaggttcccagggagagtctacctgtcaggcgtgggcaagaaaggctcagctccagcatgatccctgggtacacaggttttgtaccccgggcacagttcatctttgccaagaactgcagccaggtctgggccgaggctctgagtgactttactcacttgcatgaaaagcaagggagtgaagagctaccaaaggaggccaagggaagaaaggacacagagaaggaccaggtgccagagccggaggggcagctggaggagccgacactggaggtggtggaacaagcttctccctactccatggatgacagggaccctcggaagttcttcatgtcagctttcctgtgctcaccaaccaggcactgcaggaatttgggcagaagcactcaccaggcagtgcccaggaccccaaacatctccccccacttcccagaacataccctcagaacctgggtcttttacctaactatgggggctacgtgccagggtataagttccagtttggccacacatttggccatctcacccatgatgctctgggcctcagcaccttccagaagcagctcttggcttaggccactggacatcaagttcccttcccttttcatcctatcccagccatccttttggaagggagagaggtgggtgggagggtgggagggtgggggaacacaaagagaaaatggtttggaggctgagcaccttttttattaataggtataataaataaataaataaatacataaacagac

SEQ ID NO: 287070 - DNA, 1603 bp, Homo sapiens
cagagccttggctcaaaggcaaacaaaaggaaatgcccggctccccatggctgtggccagcaccttcataccagggctcaaccctcagaaccctcattatatcccagggtaagactcccacttagcgctccccgcttgctgctgggagtaggggtatagggtggaggaattaagctgcttagagcatggggccaagcggacaggttggtttgggaggctgaggtctctatggtggtggatggtgttctctccatgggaacagggtaacagcagaggaaggatcgaaagcccaggcagagaacttagaaatgcctgctccaaatatatacactgctgagtccagaaagatcagggcttcagaggtctccgcttctgcctctggggatggcggggcagggcgattctggtgagtgggagagtctgtgctgcaggtacactggacactgcccactacttcggttcagcgtgggccagacctatgggcaggtgactggtcagctacttcgaggccctcctggcctagcctggccccctgtccaccgcacacttctgcctcccattcggcctccaagatctcctgaggttcccagggagagtctacctgtcaggcgtgggcaagaaaggctcagctccagcatgatccctgggtacacaggttttgtaccccgggcacagttcatctttgccaagaactgcagccaggtctgggccgaggctctgagtgactttactcacttgcatgaaaagcaagggagtgaagagctaccaaaggaggccaagggaagaaaggacacagagaaggaccaggtgccagagccggaggggcagctggaggagccgacactggaggtggtggaacaagcttctccctactccatggatgacagggaccctcggaagttcttcatgtcaggtgagagctggggggtcaggatcagaggcgtggggaggccccaggatgccttggctcagtgtccccatcctcaggcttcactggctatgtgccctgcgcccgcttcctcttcggctccagctttcctgtgctcaccaaccaggcactgcaggaatttgggcagaagcactcaccaggcagtgcccaggaccccaaacatctccccccacttcccagaacataccctcagaacctgggtcttttacctaactatgggggctacgtgccaggtgagaagagcccccggggaggctttggggactggaatgtttgtttgtatgggtatggggtgggttgggtggtttgtgggggttgaaactaatagatatgggagggctcagatcatgtggttcagctttattatcaggcagaaaaggaaaccgaggtagctacccacagtggggaattagggccagattttagagggctgtttggaggtctagccaactggcttctattagggtataaagtctcattttcgccaacattcgttccactcactcataatgttctgggcttagtaccttccataatcagcttttgccttatggcacttgacatcaagtttccctgctctttccattcctatgcaaccatcctattcgtaaggtacaaatgttgactgtaagtttctcatacctctaacttacg

SEQ ID NO: 287071 - DNA, 375 bp, Homo sapiens
ggaaatgcccggctccccatggctgtggccagcaccttcataccagggctcaaccctcagaaccctcattatatcccagggtaagactcccacttagcgctccccgcttgctgctgggagtaggggtatagggtggaggaattaagctgcttagagcatggggccaagcggacaggttggtttgggaggctgaggtctctatggtggtggatggaaaaggagaagcaagggactagtgagacaccgggtctgccccaaagctttgtgttgttctctccatgggaacagggtaacagcagaggaaggatcgaaagcccaggcagagaacttagaaatgcctgctccaaatatatacactgctgagtccagaaagat

SEQ ID NO: 287072 - DNA, 939 bp, Homo sapiens
gccttggctcaaaggcaaaccaaccctcagaaccctcattatatcccagggtacactggacactgcccactacttcggttcagcgtgggccagacctatgggcaggtgactggtcagctacttcgaggccctcctggcctagcctggccccctgtccaccgcacacttctgcctcccattcggcctccaagatctcctgaggttcccagggagagtctacctgtcaggcgtgggcaagaaaggctcagctccagcatgatccctgggtacacaggttttgtaccccgggcacagttcatctttgccaagaactgcagccaggtctgggccgaggctctgagtgactttactcacttgcatgagaaggaccaggtgccagagccggaggggcagctggaggagccgacactggaggtggtggaacaagcttctccctactccatggatgacagggaccctcggaagttcttcatgtcaggcttcactggctatgtgccctgcgcccgcttcctcttcggctccagctttcctgtgctcaccaaccaggcactgcaggaatttgggcagaagcactcaccaggcagtgcccaggaccccaaacatctccccccacttcccagaacataccctcagaacctgggtcttttacctaactatgggggctacgtgccagggtataagttccagtttggccacacatttggccatctcacccatgatgctctgggcctcagcaccttccagaagcagctcttggcttaggccactggacatcaagttcccttcccttttcatcctatcccagccatccttttggaagggagagaggtgggtgggagggtgggagggtgggggaacacaaagagaaaatggtttggaggctgagcaccttttttattaataggtataataaataaataaataaatacataaacagac

SEQ ID NO: 287073 - DNA, 1320 bp, Homo sapiens
cagagccttggctcaaaggcaaacaaaaggaaatgcccggctccccatggctgtggccagcaccttcataccagggctcaaccctcagaaccctcattatatcccagggtaagactcccacttagcgctccccgcttgctgctgggagtaggggtatagggtggaggaattaagctgcttagagcatggggccaagcggacaggttggtttgggaggctgaggtctctatggtggtggatggtgttctctccatgggaacagggtaacagcagaggaaggatcgaaagcccaggcagagaacttagaaatgcctgctccaaatatatacactgctgagtccagaaagatcagggcttcagaggtctccgcttctgcctctggggatggcggggcagggcgattctggtgagtgggagagtctgtgctgcaggtacactggacactgcccactacttcggttcagcgtgggccagacctatgggcaggtgactggtcagctacttcgaggccctcctggcctagcctggccccctgtccaccgcacacttctgcctcccattcggcctccaagatctcctgaggttcccagggagagtctacctgtcaggcgtgggcaagaaaggctcagctccagcatgatccctgggtacacaggttttgtaccccgggcacagttcatctttgccaagaactgcagccaggtctgggccgaggctctgagtgactttactcacttgcatgagaaggaccaggtgccagagccggaggggcagctggaggagccgacactggaggtggtggaacaagcttctccctactccatggatgacagggaccctcggaagttcttcatgtcaggcttcactggctatgtgccctgcgcccgcttcctcttcggctccagctttcctgtgctcaccaaccaggcactgcaggaatttgggcagaagcactcaccaggcagtgcccaggaccccaaacatctccccccacttcccagaacataccctcagaacctgggtcttttacctaactatgggggctacgtgccagggtataagttccagtttggccacacatttggccatctcacccatgatgctctgggcctcagcaccttccagaagcagctcttggcttaggccactggacatcaagttcccttcccttttcatcctatcccagccatccttttggaagggagagaggtgggtgggagggtgggagggtgggggaacacaaagagaaaatggtttggaggctgagcaccttttttattaataggtataataaataaataaataaatacataaacagac

SEQ ID NO: 287074 - DNA, 929 bp, Homo sapiens
cagagccttggctcaaaggcaaacaaaaggaaatgcccggctccccatggctgtggccagcaccttcataccagggctcaaccctcagaaccctcattatatcccagggtacactggacactgcccactacttcggttcagcgtgggccagacctatgggcaggtgactggtcagctacttcgaggccctcctggcctagcctggccccctgtccaccgcacacttctgcctcccattcggcctccaagatctcctgaggttcccagggagagtctacctgtcaggcgtgggcaagaaaggctcagctccagcatgatccctgggtacacaggttttgtaccccgggcacagttcatctttgccaagaactgcagccaggtctgggccgaggctctgagtgactttactcacttgcatgagaaggaccaggtgccagagccggaggggcagctggaggagccgacactggaggtggtggaacaagcttctccctactccatggatgacagggaccctcggaagttcttcatgtcaggcactgcaggaatttgggcagaagcactcaccaggcagtgcccaggaccccaaacatctccccccacttcccagaacataccctcagaacctgggtcttttacctaactatgggggctacgtgccagggtataagttccagtttggccacacatttggccatctcacccatgatgctctgggcctcagcaccttccagaagcagctcttggcttaggccactggacatcaagttcccttcccttttcatcctatcccagccatccttttggaagggagagaggtgggtgggagggtgggagggtgggggaacacaaagagaaaatggtttggaggctgagcaccttttttattaataggtataataaataaataaataaatacataaacagac

SEQ ID NO: 287075 - DNA, 1226 bp, Homo sapiens
cagagccttggctcaaaggcaaacaaaaggaaatgcccggctccccatggctgtggccagcaccttcataccagggctcaaccctcagaaccctcattatatcccagggtacactggacactgcccactacttcggttcagcgtgggccagacctatgggcaggtgactggtcagctacttcgaggccctcctggcctagcctggccccctgtccaccgcacacttctgcctcccattcggcctccaagatctcctgaggttcccagggagagtctacctgtcaggcgtgggcaagaaaggctcagctccagcatgatccctgggtacacaggttttgtaccccgggcacagttcatctttgccaagaactgcagccaggtctgggccgaggctctgagtgactttactcacttgcatgagaaggaccaggtgccagagccggaggggcagctggaggagccgacactggaggtggtggaacaagcttctccctactccatggatgacagggaccctcggaagttcttcatgtcaggtgagagctggggggtcaggatcagaggcgtggggaggccccaggatgccttggctcagtgtccccatcctcaggcttcactggctatgtgccctgcgcccgcttcctcttcggctccagctttcctgtgctcaccaaccaggcactgcaggaatttgggcagaagcactcaccaggcagtgcccaggaccccaaacatctccccccacttcccagaacataccctcagaacctgggtcttttacctaactatgggggctacgtgccaggtgagaagagcccccggggaggctttggggactggaatgtttgtttgtatgggtatggggtgggttgggtggtttgtgggggttgaaactaatagatatgggagggctcagatcatgtggttcagctttattatcaggcagaaaaggaaaccgaggtagctacccacagtggggaattagggccagattttagagggctgtttggaggtctagccaactggcttctattagggtataaagtctcattttcgccaacattcgttccactcactcataatgttctgggcttagtaccttccataatcagcttttgccttatggcacttgacatcaagtttccctgctctttccattcctatgcaaccatcctattcgtaaggtacaaatgttgactgtaagtttctcatacctctaacttacg

SEQ ID NO: 287076 - DNA, 2800 bp, Homo sapiens
cgagcaactagccataggtggcctgggtctgaatggcagaggcagcgcgtccggcgggctgctcgctgcatctctgggcgtctttggctcgccacgctgggcagtgcctgcctgcgcctttcgcaacctcctcggccctgcgtggtctcgagctgggtgagcgagcgggcgggctggtaggctggcctgggctgcgaccggcggctacgactattctttggccgggtcggtgcgagtggtcggctgggcagagtgcacgctgcttggcgccgcaggctgatcccgccgtccactcccgggagcagtgatgttgggcaactctgcgccggggcctgcgacccgcgaggcgggctcggcgctgctagcattgcagcagacggcgctccaagaggaccaggagaatatcaacccggaaaaggcagcgcccgtccaacaaccgcggacccgggccgcgctggcggtactgaagtccgggaacccgcggggtctagcgcagcagcagaggccgaagacgagacgggttgcaccccttaaggatcttcctgtaaatgatgagcatgtcaccgttcctccttggaaagcaaacagtaaacagcctgcgttcaccattcatgtggatgaagcagaaaaagaagctcagaagaagccagctgaatctcaaaaaatagagcgtgaagatgccctggcttttaattcagccattagtttacctggacccagaaaaccattggtccctcttgattatccaatggatggtagttttgagtcaccacatactatggacatgtcaattgtattagaagatgaaaagccagtgagtgttaatgaagtaccagactaccatgaggatattcacacataccttagggaaatggaggttaaatgtaaacctaaagtgggttacatgaagaaacagccagacatcactaacagtatgagagctatcctcgtggactggttagttgaagtaggagaagaatataaactacagaatgagaccctgcatttggctgtgaactacattgataggttcctgtcttccatgtcagtgctgagaggaaaacttcagcttgtgggcactgctgctatgctgttagcctcaaagtttgaagaaatataccccccagaagtagcagagtttgtgtacattacagatgatacctacaccaagaaacaagttctgagaatggagcatctagttttgaaagtccttacttttgacttagctgctccaacagtaaatcagtttcttacccaatactttctgcatcagcagcctgcaaactgcaaagttgaaagtttagcaatgtttttgggagaattaagtttgatagatgctgacccatacctcaagtatttgccatcagttattgctggagctgcctttcatttagcactctacacagtcacgggacaaagctggcctgaatcattaatacgaaagactggatataccctggaaagtcttaagccttgtctcatggaccttcaccagacctacctcaaagcaccacagcatgcacaacagtcaataagagaaaagtacaaaaattcaaagtatcatggtgtttctctcctcaacccaccagagacactaaatctgtaacaatgaaagactgcctttgttttctaagatgtaaatcactcaaagtatatggtgtacagtttttaacttaggttttaattttacaatcatttctgaatacagaagttgtggccaagtacaaattatggtatctattactttttaaatggttttaatttgtatatcttttgtatatgtatctgtcttagatatttggctaattttaagtggttttgttaaagtattaatgatgccagctgtcaggataataaattgatttggaaaactttgcaagtcaaatttaacttcttcaggattttgcttagtaaagaagtttacttggtttactatataatgggaagtgaaaagccttcctctaaaattaaagtaggtttaggaaaacagaccctcaaattctgacattcattttcctaagcaactggatcaatttgctgacttgggcataatctaatctaagcatatctgaatacagtattcagagatagatacagtagagattccccagactttttcgctctttgtaaaacctgtttgtttaggttttgcgaggtaaactcaacagaggttgggagtggaagagggtgggaagcttatatgcaaattaacagacgagaaatgctccagaaggtttattattttaaagcacattaaaaacaaaaaactatttttaaaatcctgctagattttataatggatttgtgaataaaaaatacccagggttctcagaatggaataaatatcccttttaatagttatatatacagatatacaactgttagctttaattggcagctctcttcttttttcttcttttcactggctttttacttggtgctttttcttgttttgcactggtggtctgtgttctgtgaataaagcaaagtaagaatttactaagagtatgttaagttttggattattgaaataagaggcatttcttagttttccagtaggatctaaaatgtgtcagctatgagtaagactggcatccaagaagtttatattatagatttaggtcctaatttttataaatcacaaggtaaaaaaatcacagaacagatggatctctaatgaaaaagggatgtctttttgtttatagtcatgtggcaagatgagagtaaaaccagagagcaaacctctataagtgttgagtatatgtatacatttgaaataaaccagaaatttgttacctta

SEQ ID NO: 287077 - DNA, 2925 bp, Homo sapiens
ggacgcgtgggtcgcccacgcgtcgcccacgcgtcgttcaatagtcgcgggatacttgaactgcaagaacagccgccgctccggcgggctgctcgctgcatctctgggcgtctttggctcgccacgctgggcagtgcctgcctgcgcctttcgcaacctcctcggccctgcgtggtctcgagctgggtgagcgagcgggcgggctggtaggctggcctgggctgcgaccggcggctacgactattctttggccgggtcggtgcgagtggtcggctgggcagagtgcacgctgcttggcgccgcaggctgatcccgccgtccactcccgggagcagtgatgttgggcaactctgcgccggggcctgcgacccgcgaggcgggctcggcgctgctagcattgcagcagacggcgctccaagaggaccaggagaatatcaacccggaaaaggcagcgcccgtccaacaaccgcggacccgggccgcgctggcggtactgaagtccgggaacccgcggggtctagcgcagcagcagaggccgaagacgagacgggttgcaccccttaaggatcttcctgtaaatgatgagcatgtcaccgttcctccttggaaagcaaacagtaaacagcctgcgttcaccattcatgtggatgaagcagaaaaagaagctcagaagaagccagctgaatctcaaaaaatagagcgtgaagatgccctggcttttaattcagccattagtttacctggacccagaaaaccattggtccctcttgattatccaatggatggtagttttgagtcaccacatactatggacatgtcaattgtattagaagatgaaaagccagtgagtgttaatgaagtaccagactaccatgaggatattcacacataccttagggaaatggaggttaaatgtaaacctaaagtgggttacatgaagaaacagccagacatcactaacagtatgagagctatcctcgtggactggttagttgaagtaggagaagaatataaactacagaatgagaccctgcatttggctgtgaactacattgataggttcctgtcttccatgtcagtgctgagaggaaaacttcagcttgtgggcactgctgctatgctgttagcctcaaagtttgaagaaatataccccccagaagtagcagagtttgtgtacattacagatgatacctacaccaagaaacaagttctgagaatggagcatctagttttgaaagtccttacttttgacttagctgctccaacagtaaatcagtttcttacccaatactttctgcatcagcagcctgcaaactgcaaagttgaaagtttagcaatgtttttgggagaattaagtttgatagatgctgacccatacctcaagtatttgccatcagttattgctggagctgcctttcatttagcactctacacagtcacgggacaaagctggcctgaatcattaatacgaaagactggatataccctggaaagtcttaagccttgtctcatggaccttcaccagacctacctcaaagcaccacagcatgcacaacagtcaataagagaaaagtacaaaaattcaaagtatcatggtgtttctctcctcaacccaccagagacactaaatctgtaacaatgaaagactgcctttgttttctaagatgtaaatcactcaaagtatatggtgtacagtttttaacttaggttttaattttacaatcatttctgaatacagaagttgtggccaagtacaaattatggtatctattactttttaaatggttttaatttgtatatcttttgtatatgtatctgtcttagatatttggctaattttaagtggttttgttaaagtattaatgatgccagctgtcaggataataaattgatttggaaaactttgcaagtcaaatttaacttcttcaggattttgcttagtaaagaagtttacttggtttactatataatgggaagtgaaaagccttcctctaaaattaaagtaggtttaggaaaacagaccctcaaattctgacattcattttcctaagcaactggatcaatttgctgacttgggcataatctaatctaagcatatctgaatacagtattcagagatagatacagtagagattccccagactttttcgctctttgtaaaacctgtttgtttaggttttgcgaggtaaactcaacagaggttgggagtggaagagggtgggaagcttatatgcaaattaacagacgagaaatgctccagaaggtttattattttaaagcacattaaaaacaaaaaactatttttaaaatcctgctagattttataatggatttgtgaataaaaaatacccagggttctcagaatggaataaatatcccttttaatagttatatatacagatatacaactgttagctttaattggcagctctcttcttttttcttcttttcactggctttttacttggtgctttttcttgttttgcactggtggtctgtgttctgtgaataaagcaaagtaagaatttactaagagtatgttaagttttggattattgaaataagaggcatttcttagttttccagtaggatctaaaatgtgtcagctatgagtaagactggcatccaagaagtttatattatagatttaggtcctaatttttataaatcacaaggtaaaaaaatcacagaacagatggatctctaatgaaaaagggatgtctttttgtttatagtcatgtggcaagatgagagtaaaaccagagagcaaacctctataagtgttgagtatatgtatacatttgaaataaaccagaaatttgttaccttattttctttggattcttgtctggttccaaaatgatcatttcttcttcttcactatctgagagtattatgggagcatctttgtttttttattaattt

SEQ ID NO: 287078 - DNA, 1903 bp, Homo sapiens
ggacgcgtgggtcgcccacgcgtcgcccacgcgtcgttcaatagtcgcgggatacttgaactgcaagaacagccgccgctccggcgggctgctcgctgcatctctgggcgtctttggctcgccacgctgggcagtgcctgcctgcgcctttcgcaacctcctcggccctgcgtggtctcgagctgggtgagcgagcgggcgggctggtaggctggcctgggctgcgaccggcggctacgactattctttggccgggtcggtgcgagtggtcggctgggcagagtgcacgctgcttggcgccgcaggctgatcccgccgtccactcccgggagcagtgatgttgggcaactctgcgccggggcctgcgacccgcgaggcgggctcggcgctgctagcattgcagcagacggcgctccaagaggaccaggagaatatcaacccggaaaaggcagcgcccgtccaacaaccgcggacccgggccgcgctggcggtactgaagtccgggaacccgcggggtctagcgcagcagcagaggccgaagacgagacgggttgcaccccttaaggatcttcctgtaaatgatgagcatgtcaccgttcctccttggaaagcaaacagtaaacagcctgcgttcaccattcatgtggatgaagcagaaaaagaagctcagaagaagccagctgaatctcaaaaaatagagcgtgaagatgccctggcttttaattcagccattagtttacctggacccagaaaaccattggtccctcttgattatccaatggatggtagttttgagtcaccacatactatggacatgtcaattgtattagaagatgaaaagccagtgagtgttaatgaagtaccagactaccatgaggatattcacacataccttagggaaatggaggttaaatgtaaacctaaagtgggttacatgaagaaacagccagacatcactaacagtatgagagctatcctcgtggactggttagttgaagtaggagaagaatataaactacagaatgagaccctgcatttggctgtgaactacattgataggttcctgtcttccatgtcagtgctgagaggaaaacttcagcttgtgggcactgctgctatgctgttagcctcaaagtttgaagaaatataccccccagaagtagcagagtttgtgtacattacagatgatacctacaccaagaaacaagttctgagaatggagcatctagttttgaaagtccttacttttgacttagctgctccaacagtaaatcagtttcttacccaatactttctgcatcagcagcctgcaaactgcaaagttgaaagtttagcaatgtttttgggagaattaagtttgatagatgctgacccatacctcaagtatttgccatcagttattgctggagctgcctttcatttagcactctacacagtcacgggacaaagctggcctgaatcattaatacgaaagactggatataccctggaaagtcttaagccttgtctcatggaccttcaccagacctacctcaaagcaccacagcatgcacaacagtcaataagagaaaagtacaaaaattcaaagtatcatggtgtttctctcctcaacccaccagagacactaaatctgtaacaatgaaagactgcctttgttttctaagatgtaaatcactcaaagtatatggtgtacagtttttaacttaggttttaattttacaatcatttctgaatacagaagttgtggccaagtacaaattatggtatctattactttttaaatggttttaatttgtatatcttttgtatatgtatctgtcttagatatttggctaattttaagtggttttgttaaagtattaatgatgccagctgtcaggataataaattgatttggaaaact

SEQ ID NO: 287079 - DNA, 1785 bp, Homo sapiens
ggacgcgtgggtcgcccacgcgtcgcccacgcgtcgttcaatagtcgcgggatacttgaactgcaagaacagccgccgctccggcgggctgctcgctgcatctctgggcgtctttggctcgccacgctgggcagtgcctgcctgcgcctttcgcaacctcctcggccctgcgtggtctcgagctgggtgagcgagcgggcgggctggtaggctggcctgggctgcgaccggcggctacgactattctttggccgggtcggtgcgagtggtcggctgggcagagtgcacgctgcttggcgccgcaggctgatcccgccgtccactcccgggagcagtgatgttgggcaactctgcgccggggcctgcgacccgcgaggcgggctcggcgctgctagcattgcagcagacggcgctccaagaggaccaggagaatatcaacccggaaaaggcagcgcccgtccaacaaccgcggacccgggccgcgctggcggtactgaagtccgggaacccgcggggtctagcgcagcagcagaggccgaagacgagacgggttgcaccccttaaggatcttcctgtaaatgatgagcatgtcaccgttcctccttggaaagcaaacagtaaacagcctgcgttcaccattcatgtggatgaagcagaaaaagaagctcagaagaagccagctgaatctcaaaaaatagagcgtgaagatgccctggcttttaattcagccattagtttacctggacccagaaaaccattggtccctcttgattatccaatggatggtagttttgagtcaccacatactatggacatgtcaattgtattagaagatgaaaagccagtgagtgttaatgaagtaccagactaccatgaggatattcacacataccttagggaaatggaggttaaatgtaaacctaaagtgggttacatgaagaaacagccagacatcactaacagtatgagagctatcctcgtggactggttagttgaagtaggagaagaatataaactacagaatgagaccctgcatttggctgtgaactacattgataggttcctgtcttccatgtcagtgctgagaggaaaacttcagcttgtgggcactgctgctatgctgttagcctcaaagtttgaagaaatataccccccagaagtagcagagtttgtgtacattacagatgatacctacaccaagaaacaagttctgagaatggagcatctagttttgaaagtccttacttttgacttagctgctccaacagtaaatcagtttcttacccaatactttctgcatcagcagcctgcaaactgcaaagttgaaagtttagcaatgtttttgggagaattaagtttgatagatgctgacccatacctcaagtatttgccatcagttattgctggagctgcctttcatttagcactctacacagtcacgggacaaagctggcctgaatcattaatacgaaagactggatataccctggaaagtcttaagccttgtctcatggaccttcaccagacctacctcaaagcaccacagcatgcacaacagtcaataagagaaaagtacaaaaattcaaagtatcatggtgtttctctcctcaacccaccagagacactaaatctgtaacaatgaaagactgcctttgttttctaagatgtaaatcactcaaagtatatggtgtacagtttttaacttaggttttaattttacaatcatttctgaatacagaagttgtggccaagtacaaaaaaaaaacaaacaaaaagggcggccgc

SEQ ID NO: 287080 - DNA, 1304 bp, Homo sapiens
aagcagtggtatcaacgcagagtggccattacggccggggagaaaagtacaaaaattcaaagtatcatggtgtttctctcctcaacccaccagagacactaaatctgtaacaatgaaagactgcctttgttttctaagatgtaaatcactcaaagtatatggtgtacagtttttaacttaggttttaattttacaatcatttctgaatacagaagttgtggccaagtacaaattatggtatctattactttttaaatggttttaatttgtatatcttttgtatatgtatctgtcttagatatttggctaattttaagtggttttgttaaagtattaatgatgccagctgtcaggataataaattgatttggaaaactttgcaagtcaaatttaacttcttcaggattttgcttagtaaagaagtttacttggtttactatataatgggaagtgaaaagccttcctctaaaattaaagtaggtttaggaaaacagaccctcaaattctgacattcattttcctaagcaactggatcaatttgctgacttgggcataatctaatctaagcatatctgaatacagtattcagagatagatacagtagagattccccagactttttcgctctttgtaaaacctgtttgtttaggttttgcgaggtaaactcaacagaggttgggagtggaagagggtgggaagcttatatgcaaattaacagacgagaaatgctccagaaggtttattattttaaagcacattaaaaacaaaaaactatttttaaaatcctgctagattttataatggatttgtgaataaaaaatacccagggttctcagaatggaataaatatcccttttaatagttatatatacagatatacaactgttagctttaattggcagctctcttcttttttcttcttttcactggctttttacttggtgctttttcttgttttgcactggtggtctgtgttctgtgaataaagcaaagtaagaatttactaagagtatgttaagttttggattattgaaataagaggcatttcttagttttccagtaggatctaaaatgtgtcagctatgagtaagactggcatccaagaagtttatattatagatttaggtcctaatttttataaatcacaaggtaaaaaaatcacagaacagatggatctctaatgaaaaagggatgtctttttgtttatagtcatgtggcaagatgagagtaaaaccagagagcaaacctctataagtgttgagtatatgtatacatttgaaataaaccagaaatttgttacctta

SEQ ID NO: 287081 - DNA, 2830 bp, Homo sapiens
ggacgcgtgggtcgcccacgcgtcgcccacgcgtcgttcaatagtcgcgggatacttgaactgcaagaacagccgccgctccggcgggctgctcgctgcatctctgggcgtctttggctcgccacgctgggcagtgcctgcctgcgcctttcgcaacctcctcggccctgcgtggtctcgagctgggtgagcgagcgggcgggctggtaggctggcctgggctgcgaccggcggctacgactattctttggccgggtcggtgcgagtggtcggctgggcagagtgcacgctgcttggcgccgcaggctgatcccgccgtccactcccgggagcagtgatgttgggcaactctgcgccggggcctgcgacccgcgaggcgggctcggcgctgctagcattgcagcagacggcgctccaagaggaccaggagaatatcaacccggaaaaggcagcgcccgtccaacaaccgcggacccgggccgcgctggcggtactgaagtccgggaacccgcggggtctagcgcagcagcagaggccgaagacgagacgggttgcaccccttaaggatcttcctgtaaatgatgagcatgtcaccgttcctccttggaaagcaaacagtaaacagcctgcgttcaccattcatgtggatgaagcagaaaaagaagctcagaagaagccagctgaatctcaaaaaatagagcgtgaagatgccctggcttttaattcagccattagtttacctggacccagaaaaccattggtccctcttgattatccaatggatggtagttttgagtcaccacatactatggacatgtcaattgtattagaagatgaaaagccagtgagtgttaatgaagtaccagactaccatgaggatattcacacataccttagggaaatggaggttaaatgtaaacctaaagtgggttacatgaagaaacagccagacatcactaacagtatgagagctatcctcgtggactggttagttgaagtaggagaagaatataaactacagaatgagaccctgcatttggctgtgaactacattgataggttcctgtcttccatgtcagtgctgagaggaaaacttcagcttgtgggcactgctgctatgctgttagcctcaaagtttgaagaaatataccccccagaagtagcagagtttgtgtacattacagatgatacctacaccaagaaacaagttctgagaatggagcatctagttttgaaagtccttacttttgacttagctgctccaacagtaaatcagtttcttacccaatactttctgcatcagcagcctgcaaactgcaaagttgaaagtttagcaatgtttttgggagaattaagtttgatagatgctgacccatacctcaagtatttgccatcagttattgctggagctgcctttcatttagcactctacacagtcacgggacaaagctggcctgaatcattaatacgaaagactggatataccctggaaagtcttaagccttgtctcatggaccttcaccagacctacctcaaagcaccacagcatgcacaacagtcaataagagaaaagtacaaaaattcaaagtatcatggtgtttctctcctcaacccaccagagacactaaatctgtaacaatgaaagactgcctttgttttctaagatgtaaatcactcaaagtatatggtgtacagtttttaacttaggttttaattttacaatcatttctgaatacagaagttgtggccaagtacaaattatggtatctattactttttaaatggttttaatttgtatatcttttgtatatgtatctgtcttagatatttggctaattttaagtggttttgttaaagtattaatgatgccagctgtcaggataataaattgatttggaaaactttgcaagtcaaatttaacttcttcaggattttgcttagtaaagaagtttacttggtttactatataatgggaagtgaaaagccttcctctaaaattaaagtaggtttaggaaaacagaccctcaaattctgacattcattttcctaagcaactggatcaatttgctgacttgggcataatctaatctaagcatatctgaatacagtattcagagatagatacagtagagattccccagactttttcgctctttgtaaaacctgtttgtttaggttttgcgaggtaaactcaacagaggttgggagtggaagagggtgggaagcttatatgcaaattaacagacgagaaatgctccagaaggtttattattttaaagcacattaaaaacaaaaaactatttttaaaatcctgctagattttataatggatttgtgaataaaaaatacccagggttctcagaatggaataaatatcccttttaatagttatatatacagatatacaactgttagctttaattggcagctctcttcttttttcttcttttcactggctttttacttggtgctttttcttgttttgcactggtggtctgtgttctgtgaataaagcaaagtaagaatttactaagagtatgttaagttttggattattgaaataagaggcatttcttagttttccagtaggatctaaaatgtgtcagctatgagtaagactggcatccaagaagtttatattatagatttaggtcctaatttttataaatcacaaggtaaaaaaatcacagaacagatggatctctaatgaaaaagggatgtctttttgtttatagtcatgtggcaagatgagagtaaaaccagagagcaaacctctataagtgttgagtatatgtatacatttgaaataaaccagaaatttgttacctta

SEQ ID NO: 287082 - DNA, 2391 bp, Homo sapiens
cagtttgcaggctgctgatgcagaaagtattgggtaagaaactgatttactgttggagcagctaagtcaaaagtaaggactttcaaaactagatgctccattctcagaacttgtttcttggtgtaggtatcatctgtaatgtacacaaactctgctacttctggggggtatatttcttcaaactttgactagttctagatcgcgagcggccgctcgcgatctagaactcagaagaagccagctgaatctcaaaaaatagagcgtgaagatgccctggcttttaattcagccattagtttacctggacccagaaaaccattggtccctcttgattatccaatggatggtagttttgagtcaccacatactatggacatgtcaattgtattagaagatgaaaagccagtgagtgttaatgaagtaccagactaccatgaggatattcacacataccttagggaaatggaggttaaatgtaaacctaaagtgggttacatgaagaaacagccagacatcactaacagtatgagagctatcctcgtggactggttagttgaagtaggagaagaatataaactacagaatgagaccctgcatttggctgtgaactacattgataggttcctgtcttccatgtcagtgctgagaggaaaacttcagcttgtgggcactgctgctatgctgttagcctcaaagtttgaagaaatataccccccagaagtagcagagtttgtgtacattacagatgatacctacaccaagaaacaagttctgagaatggagcatctagttttgaaagtccttacttttgacttagctgctccaacagtaaatcagtttcttacccaatactttctgcatcagcagcctgcaaactgcaaagttgaaagtttagcaatgtttttgggagaattaagtttgatagatgctgacccatacctcaagtatttgccatcagttattgctggagctgcctttcatttagcactctacacagtcacgggacaaagctggcctgaatcattaatacgaaagactggatataccctggaaagtcttaagccttgtctcatggaccttcaccagacctacctcaaagcaccacagcatgcacaacagtcaataagagaaaagtacaaaaattcaaagtatcatggtgtttctctcctcaacccaccagagacactaaatctgtaacaatgaaagactgcctttgttttctaagatgtaaatcactcaaagtatatggtgtacagtttttaacttaggttttaattttacaatcatttctgaatacagaagttgtggccaagtacaaattatggtatctattactttttaaatggttttaatttgtatatcttttgtatatgtatctgtcttagatatttggctaattttaagtggttttgttaaagtattaatgatgccagctgtcaggataataaattgatttggaaaactttgcaagtcaaatttaacttcttcaggattttgcttagtaaagaagtttacttggtttactatataatgggaagtgaaaagccttcctctaaaattaaagtaggtttaggaaaacagaccctcaaattctgacattcattttcctaagcaactggatcaatttgctgacttgggcataatctaatctaagcatatctgaatacagtattcagagatagatacagtagagattccccagactttttcgctctttgtaaaacctgtttgtttaggttttgcgaggtaaactcaacagaggttgggagtggaagagggtgggaagcttatatgcaaattaacagacgagaaatgctccagaaggtttattattttaaagcacattaaaaacaaaaaactatttttaaaatcctgctagattttataatggatttgtgaataaaaaatacccagggttctcagaatggaataaatatcccttttaatagttatatatacagatatacaactgttagctttaattggcagctctcttcttttttcttcttttcactggctttttacttggtgctttttcttgttttgcactggtggtctgtgttctgtgaataaagcaaagtaagaatttactaagagtatgttaagttttggattattgaaataagaggcatttcttagttttccagtaggatctaaaatgtgtcagctatgagtaagactggcatccaagaagtttatattatagatttaggtcctaatttttataaatcacaaggtaaaaaaatcacagaacagatggatctctaatgaaaaagggatgtctttttgtttatagtcatgtggcaagatgagagtaaaaccagagagcaaacctctataagtgttgagtatatgtatacatttgaaataaaccagaaatttgttacctta

SEQ ID NO: 287083 - DNA, 855 bp, Homo sapiens
  misc_feature (831)..(831): n is a, c, g, or t
  misc_feature (848)..(848): n is a, c, g, or t
ggacgcgtgggtcgcccacgcgtcgcccacgcgtcgttcaatagtcgcgggatacttgaactgcaagaacagccgccgctccggcgggctgctcgctgcatctctgggcgtctttggctcgccacgctgggcagtgcctgcctgcgcctttcgcaacctcctcggccctgcgtggtctcgagctgggtgagcgagcgggcgggctggtaggctggcctgggctgcgaccggcggctacgactattctttggccgggtcggtgcgagtggtcggctgggcagagtgcacgctgcttggcgccgcaggctgatcccgccgtccactcccgggagcagtgatgttgggcaactctgcgccggggcctgcgacccgcgaggcgggctcggcgctgctagcattgcagcagacggcgctccaagaggaccaggagaatatcaacccggaaaaggcagcgcccgtccaacaaccgcggacccgggccgcgctggcggtactgaagtccgggaacccgcggggtctagcgcagcagcagaggccgaagacgagacgggttgcaccccttaaggatcttcctgtaaatgatgagcatgtcaccgttcctccttggaaagcaaacagtaaacagcctgcgttcaccattcatgtggatgaagcagaaaaagaagctcagaagaagccagctgaatctcaaaaaatagagcgtgaagatgccctggcttttaattcagccattagtttacctggacccagaaaaccattggtccctcttgattatccaatggatggtagttttgatcacacatatatggactgtcatgtatagagataaancatgatgtatgagtcanatctaga

SEQ ID NO: 287084 - DNA, 681 bp, Homo sapiens
ctatagtacccttcagctaagcacacggccgccggccctccctcctctcctcatccagcactagcccccagctgtctctttcctcccggtgcccacgatcgcaccgcccagaccaccctactctccctgccccggaagttacacactgccgacaccgggacgtaacttccgggaagggcttacttccaagacagacacggaagtgctgggaggcgccgggagcccgttcggttgcgggtgtctctggccctgcggtcagccctccagcctgggcaacagagcaaaactccaactcaaaaacaaaaacaaaaacaccttgaaaaacactgccttagtatacttaaactatcttttcatctatcagattgttaaggattttttttaaatttgacaacatccagtgtcaatgagggtgagggcaaaaaaaggactaccttggtgagaatgtaagttgtttaatcctttgggagggttaagctgtagatatctaaattttaaatatatatttatcctcttccatgttaagaaccctaagaaataactggacgagtgtggtatgatgtttgcatgtgatattcattacagtattattttaatagtagaaaattgttaaaaatctatatgtccattaataggaaattggttaaataaaatgaggcttccacaaactgaaaaaaaaaa

SEQ ID NO: 287085 - DNA, 739 bp, Homo sapiens
cctcatcttcttacgtctgaatcagctcctggaaccgagcacaaggcctgcacgcagtagatcctcaagaaatatttacggggctgggcacggtggctcacgcctgtaatcccagcactttgggaggctgaggcgggtggatcaagaggtcaggagatcgagaccatcctggctaagtcggtctctaataaaaatacaaaaaattagccaggcgtggtggcacgcgcctgtagtcccagctactcgggaggctgaggcaggaagaatcgcttgaacccgggaggcagaggttgcagtgagccgagaccgcgccactgcactccagcctgggcaacagagcaaaactccaactcaaaaacaaaaacaaaaacaccttgaaaaacactgccttagtatacttaaactatcttttcatctatcagattgttaaggattttttttaaatttgacaacatccagtgtcaatgagggtgagggcaaaaaaaggactaccttggtgagaatgtaagttgtttaatcctttgggagggttaagctgtagatatctaaattttaaatatatatttatcctcttccatgttaagaaccctaagaaataactggacgagtgtggtatgatgtttgcatgtgatattcattacagtattattttaatagtagaaaattgttaaaaatctatatgtccattaataggaaattggttaaataaaatgaggcttccacaaactgaaaaaaaaaa

SEQ ID NO: 287086 - DNA, 427 bp, Homo sapiens
tgaaaggacatgtatatgtctgaccaaaacagtctgcccagactcccgagcagcagtggaacttaaggaattgttttctccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtca

SEQ ID NO: 287087 - DNA, 4073 bp, Homo sapiens
ctatagtacccttcagctaagcacacggccgccggccctccctcctctcctcatccagcactagcccccagctgtctctttcctcccggtgcccacgatcgcaccgcccagaccaccctactctccctgccccggaagttacacactgccgacaccgggacgtaacttccgggaagggcttacttccaagacagacacggaagtgctgggaggcgccgggagcccgttcggttgcgggtgtctctggccctgcggtcagccctgggaacgtcccggagagctagattcctagaggcccgattccgctagcccggaacagacaaagccagcgctcccgcccgctccccgacttaggatccgatgccggcagcgtcctggggcccccgtagcggggctggaccatgagcctgctggacggcctcgcttcctcgccgcgggctccgctgcagtccagcaaggccaggatgaaaaagctcccgaagaagagccagaatgagaagtaccggctgaagtacctgcggctgcgcaaagcggccaaggccacggtgtttgaaaatgctgctatttgtgatgaaattgctcgtcttgaggaaaaatttcttaaagcaaaagaagaaagaaggtacttgctaaagaagctcctccagcttcaggctctaactgaaggggaagtacaggctgcagctccttcccacagttccagtttgcccctgacttatggtgtggccagctctgtgggaactatacagggagctgggcctatttcagggcccagcactggggctgaggaaccatttgggaagaaaactaagaaggagaaaaaagaaaaaggcaaagagaacaacaaactggaagccccaaagtggttctaaaggctaccacaggaaactggacttctaaattcttcagtgacctcaatcccaggttgggggaatgttttttatagatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcagtttgaaattgttcctgaagatgacccccagaatgccattgtcagctcttctgcagatgcttgtcatgcagaactgctcaggactataagcactactatggggaaactaatgcctaacctgcttccagctggagctgacttttttggattttctcatccagccatccacaacctgatccagagctgtccaggagctcgaaaatgcatcaattaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtcaattctgtttactttcatcttgtaatcgggatgtaatcttttttgcttagctctgcctgaggtaaagtaaacttcagcctcttataaacaagagtgatagagagctgcaggctgctacaacaaataccatagacaggttggtttataaataacatgaatttatttctcacagttctggatgctgggaagtccaagttcaaggagcgcagattcaatgtctggtgagggcccacttcctagttcttagacagctgtcttcctgcagtgtcctcacgtggtagaagaggaaggcagctctccggggtcccttttataagatcactaagccggttcatgagaggtctgctctcatgacctaatcacctcccaaaggccccacctcccaataccatcacattaggggttaggatttaacatgaattttggggacatataaacattaagtctgtagtagcagcagctgactaacgagggagatagggagattctgacaaacttctactcttgattgtgatcctaattcaaggaatatcaagtcccagcccctgcaacccaggctgctgcttaattttcatgtcagtatcatcaaaatccaatgttctgcttaaactcaagatggaaagtccagtccaaggtacactgttcatctttttcttcacattttgcacatccttcaaggggatctttaacctctttaacctttgtattgcacctcagataatgtgctttttagctcagtacactgaaaccatatgataacacaaattcacatataattgggggttagtcccatactctataacagacttagtcctgtcttttcattagccatgtaataatataactccatgttccatgcaactggatttttggaccctgttaatagcattaaggtagaggtttactctatcacctaacacctcaacactacctgtgggatgccttagttacccagcagcaggttaccaagggctgtctggaaagggagggacaaaaggacccagaagtagaagaatggggatggagtggtgagaattgaatggttaatgcactgccattcataattgccaattgaggacaacacaaatgggattggtactttatagtaataaatctgaccagcagagggagggatcaggcagcagtgtttagagcacaccacactggccactgtaaactgagaagctaagttaactggtattttatgattttgagtatagtctttttataagttgtatacactttacaatgtaaaagaaacaaactttgtataatagcaaatcgggaaggggactgcttaaaatgttaatgcagtgtttttctttttttctctgcataaatggcttgagcatactggcatttacacagaaatgatatatgctgcttttatcatataacaaatattttcccactattacagcctgagtaatacccgtattaaaagagcctcattttagaaagacatttaaaatttttggaacataccacatgtagaaaggttgaactggtttttcagctataatgcatatacaactatagtgtgtacgtataccacatatacatatacttgtatgaagatatgtgtaaaatgtttttactatggatcatggatttaagaaacttgaaaagctgggcacggtggctcacgcctgtaatcccagcactttgggaggctgaggcgggtggatcaagaggtcaggagatcgagaccatcctggctaagtcggtctctaataaaaatacaaaaaattagccaggcgtggtggcacgcgcctgtagtcccagctactcgggaggctgaggcaggaagaatcgcttgaacccgggaggcagaggttgcagtgagccgagaccgcgccactgcactccagcctgggcaacagagcaaaactccaactcaaaaacaaaaacaaaaacaccttgaaaaacactgccttagtatacttaaactatcttttcatctatcagattgttaaggattttttttaaatttgacaacatccagtgtcaatgagggtgagggcaaaaaaaggactaccttggtgagaatgtaagttgtttaatcctttgggagggttaagctgtagatatctaaattttaaatatatatttatcctcttccatgttaagaaccctaagaaataactggacgagtgtggtatgatgtttgcatgtgatattcattacagtattattttaatagtagaaaattgttaaaaatctatatgtccattaataggaaattggttaaataaaatgaggcttccacaaactgaaaaaaaaaa

SEQ ID NO: 287088 - DNA, 4348 bp, Homo sapiens
ctatagtacccttcagctaagcacacggccgccggccctccctcctctcctcatccagcactagcccccagctgtctctttcctcccggtgcccacgatcgcaccgcccagaccaccctactctccctgccccggaagttacacactgccgacaccgggacgtaacttccgggaagggcttacttccaagacagacacggaagtgctgggaggcgccgggagcccgttcggttgcgggtgtctctggccctgcggtcagccctgggaacgtcccggagagctagattcctagaggcccgattccgctagcccggaacagacaaagccagcgctcccgcccgctccccgacttaggatccgatgccggcagcgtcctggggcccccgtagcggggctggaccatgagcctgctggacggcctcgcttcctcgccgcgggctccgctgcagtccagcaaggccaggatgaaaaagctcccgaagaagagccagaatgagaagtaccggctgaagtacctgcggctgcgcaaagcggccaaggccacggtgtttgaaaatgctgctatttgtgatgaaattgctcgtcttgaggaaaaatttcttaaagcaaaagaagaaagaaggtacttgctaaagaagctcctccagcttcaggctctaactgaaggggaagtacaggctgcagctccttcccacagttccagtttgcccctgacttatggtgtggccagctctgtgggaactatacagggagctgggcctatttcagggcccagcactggggctgaggaaccatttgggaagaaaactaagaaggagaaaaaagaaaaaggcaaagagaacaacaaactggaagttctgaagaaaacatgcaagaaaaagaaaatggcgggaggtgctcgcaagctggttcagcccattgccctggatccctcaggacggcctgtgttccccatcggactagggggtctaacagtatatagcctgggggaggtgagtgagaccagcgatatatagagaggagaatcagggaaatacgggaatggggttgagccttccctccctgttcccattagcagcagcctcttgctgatccataccaaccccagcgtatctccagtccctgcaaaaccccaaagtggttctaaaggctaccacaggaaactggacttctaaattcttcagtgacctcaatcccaggttgggggaatgttttttatagatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcagtttgaaattgttcctgaagatgacccccagaatgccattgtcagctcttctgcagatgcttgtcatgcagaactgctcaggactataagcactactatggggaaactaatgcctaacctgcttccagctggagctgacttttttggattttctcatccagccatccacaacctgatccagagctgtccaggagctcgaaaatgcatcaattaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtcaattctgtttactttcatcttgtaatcgggatgtaatcttttttgcttagctctgcctgaggtaaagtaaacttcagcctcttataaacaagagtgatagagagctgcaggctgctacaacaaataccatagacaggttggtttataaataacatgaatttatttctcacagttctggatgctgggaagtccaagttcaaggagcgcagattcaatgtctggtgagggcccacttcctagttcttagacagctgtcttcctgcagtgtcctcacgtggtagaagaggaaggcagctctccggggtcccttttataagatcactaagccggttcatgagaggtctgctctcatgacctaatcacctcccaaaggccccacctcccaataccatcacattaggggttaggatttaacatgaattttggggacatataaacattaagtctgtagtagcagcagctgactaacgagggagatagggagattctgacaaacttctactcttgattgtgatcctaattcaaggaatatcaagtcccagcccctgcaacccaggctgctgcttaattttcatgtcagtatcatcaaaatccaatgttctgcttaaactcaagatggaaagtccagtccaaggtacactgttcatctttttcttcacattttgcacatccttcaaggggatctttaacctctttaacctttgtattgcacctcagataatgtgctttttagctcagtacactgaaaccatatgataacacaaattcacatataattgggggttagtcccatactctataacagacttagtcctgtcttttcattagccatgtaataatataactccatgttccatgcaactggatttttggaccctgttaatagcattaaggtagaggtttactctatcacctaacacctcaacactacctgtgggatgccttagttacccagcagcaggttaccaagggctgtctggaaagggagggacaaaaggacccagaagtagaagaatggggatggagtggtgagaattgaatggttaatgcactgccattcataattgccaattgaggacaacacaaatgggattggtactttatagtaataaatctgaccagcagagggagggatcaggcagcagtgtttagagcacaccacactggccactgtaaactgagaagctaagttaactggtattttatgattttgagtatagtctttttataagttgtatacactttacaatgtaaaagaaacaaactttgtataatagcaaatcgggaaggggactgcttaaaatgttaatgcagtgtttttctttttttctctgcataaatggcttgagcatactggcatttacacagaaatgatatatgctgcttttatcatataacaaatattttcccactattacagcctgagtaatacccgtattaaaagagcctcattttagaaagacatttaaaatttttggaacataccacatgtagaaaggttgaactggtttttcagctataatgcatatacaactatagtgtgtacgtataccacatatacatatacttgtatgaagatatgtgtaaaatgtttttactatggatcatggatttaagaaacttgaaaagctgggcacggtggctcacgcctgtaatcccagcactttgggaggctgaggcgggtggatcaagaggtcaggagatcgagaccatcctggctaagtcggtctctaataaaaatacaaaaaattagccaggcgtggtggcacgcgcctgtagtcccagctactcgggaggctgaggcaggaagaatcgcttgaacccgggaggcagaggttgcagtgagccgagaccgcgccactgcactccagcctgggcaacagagcaaaactccaactcaaaaacaaaaacaaaaacaccttgaaaaacactgccttagtatacttaaactatcttttcatctatcagattgttaaggattttttttaaatttgacaacatccagtgtcaatgagggtgagggcaaaaaaaggactaccttggtgagaatgtaagttgtttaatcctttgggagggttaagctgtagatatctaaattttaaatatatatttatcctcttccatgttaagaaccctaagaaataactggacgagtgtggtatgatgtttgcatgtgatattcattacagtattattttaatagtagaaaattgttaaaaatctatatgtccattaataggaaattggttaaataaaatgaggcttccacaaactgaaaaaaaaaa

SEQ ID NO: 287089 - DNA, 4745 bp, Homo sapiens
ctatagtacccttcagctaagcacacggccgccggccctccctcctctcctcatccagcactagcccccagctgtctctttcctcccggtgcccacgatcgcaccgcccagaccaccctactctccctgccccggaagttacacactgccgacaccgggacgtaacttccgggaagggcttacttccaagacagacacggaagtgctgggaggcgccgggagcccgttcggttgcgggtgtctctggccctgcggtcagccctgggaacgtcccggagagctagattcctagaggcccgattccgctagcccggaacagacaaagccagcgctcccgcccgctccccgacttaggatccgatgccggcagcgtcctggggcccccgtagcggggctggaccatgagcctgctggacggcctcgcttcctcgccgcgggctccgctgcagtccagcaaggccaggatgaaaaagctcccgaagaagagccagaatgagaagtaccggctgaagtacctgcggctgcgcaaagcggccaaggccacggtgtttgaaaatgctgctatttgtgatgaaattgctcgtcttgaggaaaaatttcttaaagcaaaagaagaaagaaggtgagctggcttcattttgtgttcagcatcacctttttggtgattgatttggtgattgataatggtgttactgctctgggagactttttttcccagtgggattgatgcgtatcgcacagccccttggccacttgatcaagcacagagaaacttacagcctgaggcattggtgcctgcacacccaagttatgttgggccatggcgatgagacagctcctctactcatctttctgaaaaagccatcttgccacatctaataaataatcttactaagattatttaatcttatggcccaattataaaagccaagtgataaaagcaactgcctctcgttctacaaatatttattctgtacgtactattctgtgcaaagcacaatgggtatatatacatgtgtaaataatgtgcctttcagaagcctaacaccgtccaacatcaaggtagaggaaccgtccagatgcaagagataagctacagttcttatccttggcctcttgaagtattgattatcctccagggctttatgattcatagggcctaataagaacctttcttttatgagtatagtaatctttgtatataattctggcttttcccagtacttgagtaaaatactgaattgagacaatacggaagttcatttctctgctcctttccttcctgatctcaggtgtacttgctaaagaagctcctccagcttcaggctctaactgaaggggaagtacaggctgcagctccttcccacagttccagtttgcccctgacttatggtgtggccagctctgtgggaactatacagggagctgggcctatttcagggcccagcactggggctgaggaaccatttgggaagaaaactaagaaggagaaaaaagaaaaaggcaaagagaacaacaaactggaagccccaaagtggttctaaaggctaccacaggaaactggacttctaaattcttcagtgacctcaatcccaggttgggggaatgttttttatagatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcagtttgaaattgttcctgaagatgacccccagaatgccattgtcagctcttctgcagatgcttgtcatgcagaactgctcaggactataagcactactatggggaaactaatgcctaacctgcttccagctggagctgacttttttggattttctcatccagccatccacaacctgatccagagctgtccaggagctcgaaaatgcatcaattaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtcaattctgtttactttcatcttgtaatcgggatgtaatcttttttgcttagctctgcctgaggtaaagtaaacttcagcctcttataaacaagagtgatagagagctgcaggctgctacaacaaataccatagacaggttggtttataaataacatgaatttatttctcacagttctggatgctgggaagtccaagttcaaggagcgcagattcaatgtctggtgagggcccacttcctagttcttagacagctgtcttcctgcagtgtcctcacgtggtagaagaggaaggcagctctccggggtcccttttataagatcactaagccggttcatgagaggtctgctctcatgacctaatcacctcccaaaggccccacctcccaataccatcacattaggggttaggatttaacatgaattttggggacatataaacattaagtctgtagtagcagcagctgactaacgagggagatagggagattctgacaaacttctactcttgattgtgatcctaattcaaggaatatcaagtcccagcccctgcaacccaggctgctgcttaattttcatgtcagtatcatcaaaatccaatgttctgcttaaactcaagatggaaagtccagtccaaggtacactgttcatctttttcttcacattttgcacatccttcaaggggatctttaacctctttaacctttgtattgcacctcagataatgtgctttttagctcagtacactgaaaccatatgataacacaaattcacatataattgggggttagtcccatactctataacagacttagtcctgtcttttcattagccatgtaataatataactccatgttccatgcaactggatttttggaccctgttaatagcattaaggtagaggtttactctatcacctaacacctcaacactacctgtgggatgccttagttacccagcagcaggttaccaagggctgtctggaaagggagggacaaaaggacccagaagtagaagaatggggatggagtggtgagaattgaatggttaatgcactgccattcataattgccaattgaggacaacacaaatgggattggtactttatagtaataaatctgaccagcagagggagggatcaggcagcagtgtttagagcacaccacactggccactgtaaactgagaagctaagttaactggtattttatgattttgagtatagtctttttataagttgtatacactttacaatgtaaaagaaacaaactttgtataatagcaaatcgggaaggggactgcttaaaatgttaatgcagtgtttttctttttttctctgcataaatggcttgagcatactggcatttacacagaaatgatatatgctgcttttatcatataacaaatattttcccactattacagcctgagtaatacccgtattaaaagagcctcattttagaaagacatttaaaatttttggaacataccacatgtagaaaggttgaactggtttttcagctataatgcatatacaactatagtgtgtacgtataccacatatacatatacttgtatgaagatatgtgtaaaatgtttttactatggatcatggatttaagaaacttgaaaagctgggcacggtggctcacgcctgtaatcccagcactttgggaggctgaggcgggtggatcaagaggtcaggagatcgagaccatcctggctaagtcggtctctaataaaaatacaaaaaattagccaggcgtggtggcacgcgcctgtagtcccagctactcgggaggctgaggcaggaagaatcgcttgaacccgggaggcagaggttgcagtgagccgagaccgcgccactgcactccagcctgggcaacagagcaaaactccaactcaaaaacaaaaacaaaaacaccttgaaaaacactgccttagtatacttaaactatcttttcatctatcagattgttaaggattttttttaaatttgacaacatccagtgtcaatgagggtgagggcaaaaaaaggactaccttggtgagaatgtaagttgtttaatcctttgggagggttaagctgtagatatctaaattttaaatatatatttatcctcttccatgttaagaaccctaagaaataactggacgagtgtggtatgatgtttgcatgtgatattcattacagtattattttaatagtagaaaattgttaaaaatctatatgtccattaataggaaattggttaaataaaatgaggcttccacaaactgaaaaaaaaaa

SEQ ID NO: 287090 - DNA, 4366 bp, Homo sapiens
aacctgactacctttatctatggatttatttatagtttgtcacacggtcgaatagctccttcttctcagtaatacaagcttttttggtttgaaatatggatcctcttcccagcataataatgtgattttttttattcattttatgttattatattcacatttttacttaaaggaaaatgctgctatttgtgatgaaattgctcgtcttgaggaaaaatttcttaaagcaaaagaagaaagaaggtgagctggcttcattttgtgttcagcatcacctttttggtgattgatttggtgattgataatggtgttactgctctgggagactttttttcccagtgggattgatgcgtatcgcacagccccttggccacttgatcaagcacagagaaacttacagcctgaggcattggtgcctgcacacccaagttatgttgggccatggcgatgagacagctcctctactcatctttctgaaaaagccatcttgccacatctaataaataatcttactaagattatttaatcttatggcccaattataaaagccaagtgataaaagcaactgcctctcgttctacaaatatttattctgtacgtactattctgtgcaaagcacaatgggtatatatacatgtgtaaataatgtgcctttcagaagcctaacaccgtccaacatcaaggtagaggaaccgtccagatgcaagagataagctacagttcttatccttggcctcttgaagtattgattatcctccagggctttatgattcatagggcctaataagaacctttcttttatgagtatagtaatctttgtatataattctggcttttcccagtacttgagtaaaatactgaattgagacaatacggaagttcatttctctgctcctttccttcctgatctcaggtgtacttgctaaagaagctcctccagcttcaggctctaactgaaggggaagtacaggctgcagctccttcccacagttccagtttgcccctgacttatggtgtggccagctctgtgggaactatacagggagctgggcctatttcagggcccagcactggggctgaggaaccatttgggaagaaaactaagaaggagaaaaaagaaaaaggcaaagagaacaacaaactggaagccccaaagtggttctaaaggctaccacaggaaactggacttctaaattcttcagtgacctcaatcccaggttgggggaatgttttttatagatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcagtttgaaattgttcctgaagatgacccccagaatgccattgtcagctcttctgcagatgcttgtcatgcagaactgctcaggactataagcactactatggggaaactaatgcctaacctgcttccagctggagctgacttttttggattttctcatccagccatccacaacctgatccagagctgtccaggagctcgaaaatgcatcaattaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtcaattctgtttactttcatcttgtaatcgggatgtaatcttttttgcttagctctgcctgaggtaaagtaaacttcagcctcttataaacaagagtgatagagagctgcaggctgctacaacaaataccatagacaggttggtttataaataacatgaatttatttctcacagttctggatgctgggaagtccaagttcaaggagcgcagattcaatgtctggtgagggcccacttcctagttcttagacagctgtcttcctgcagtgtcctcacgtggtagaagaggaaggcagctctccggggtcccttttataagatcactaagccggttcatgagaggtctgctctcatgacctaatcacctcccaaaggccccacctcccaataccatcacattaggggttaggatttaacatgaattttggggacatataaacattaagtctgtagtagcagcagctgactaacgagggagatagggagattctgacaaacttctactcttgattgtgatcctaattcaaggaatatcaagtcccagcccctgcaacccaggctgctgcttaattttcatgtcagtatcatcaaaatccaatgttctgcttaaactcaagatggaaagtccagtccaaggtacactgttcatctttttcttcacattttgcacatccttcaaggggatctttaacctctttaacctttgtattgcacctcagataatgtgctttttagctcagtacactgaaaccatatgataacacaaattcacatataattgggggttagtcccatactctataacagacttagtcctgtcttttcattagccatgtaataatataactccatgttccatgcaactggatttttggaccctgttaatagcattaaggtagaggtttactctatcacctaacacctcaacactacctgtgggatgccttagttacccagcagcaggttaccaagggctgtctggaaagggagggacaaaaggacccagaagtagaagaatggggatggagtggtgagaattgaatggttaatgcactgccattcataattgccaattgaggacaacacaaatgggattggtactttatagtaataaatctgaccagcagagggagggatcaggcagcagtgtttagagcacaccacactggccactgtaaactgagaagctaagttaactggtattttatgattttgagtatagtctttttataagttgtatacactttacaatgtaaaagaaacaaactttgtataatagcaaatcgggaaggggactgcttaaaatgttaatgcagtgtttttctttttttctctgcataaatggcttgagcatactggcatttacacagaaatgatatatgctgcttttatcatataacaaatattttcccactattacagcctgagtaatacccgtattaaaagagcctcattttagaaagacatttaaaatttttggaacataccacatgtagaaaggttgaactggtttttcagctataatgcatatacaactatagtgtgtacgtataccacatatacatatacttgtatgaagatatgtgtaaaatgtttttactatggatcatggatttaagaaacttgaaaagctgggcacggtggctcacgcctgtaatcccagcactttgggaggctgaggcgggtggatcaagaggtcaggagatcgagaccatcctggctaagtcggtctctaataaaaatacaaaaaattagccaggcgtggtggcacgcgcctgtagtcccagctactcgggaggctgaggcaggaagaatcgcttgaacccgggaggcagaggttgcagtgagccgagaccgcgccactgcactccagcctgggcaacagagcaaaactccaactcaaaaacaaaaacaaaaacaccttgaaaaacactgccttagtatacttaaactatcttttcatctatcagattgttaaggattttttttaaatttgacaacatccagtgtcaatgagggtgagggcaaaaaaaggactaccttggtgagaatgtaagttgtttaatcctttgggagggttaagctgtagatatctaaattttaaatatatatttatcctcttccatgttaagaaccctaagaaataactggacgagtgtggtatgatgtttgcatgtgatattcattacagtattattttaatagtagaaaattgttaaaaatctatatgtccattaataggaaattggttaaataaaatgaggcttccacaaactgaaaaaaaaaa

SEQ ID NO: 287091 - DNA, 1694 bp, Homo sapiens
ctatagtacccttcagctaagcacacggccgccggccctccctcctctcctcatccagcactagcccccagctgtctctttcctcccggtgcccacgatcgcaccgcccagaccaccctactctccctgccccggaagttacacactgccgacaccgggacgtaacttccgggaagggcttacttccaagacagacacggaagtgctgggaggcgccgggagcccgttcggttgcgggtgtctctggccctgcggtcagccctgggaacgtcccggagagctagattcctagaggcccgattccgctagcccggaacagacaaagccagcgctcccgcccgctccccgacttaggatccgatgccggcagcgtcctggggcccccgtagcggggctggaccatgagcctgctggacggcctcgcttcctcgccgcgggctccgctgcagtccagcaaggccaggatgaaaaagctcccgaagaagagccagaatgagaagtaccggctgaagtacctgcggctgcgcaaagcggccaaggccacggtgtttgtgagtctgacccacgttcagccggtcccctcctggagactccctcacaaaatctttccccaagctgttcccccttcccagtgtgacagtattaatacagtgttggcttttccgtatacgttactacttgttagccttgtgtccttggacaaattacgtaatttctctgtgtcctcatctgtaaatgagctagtaactgtcttgcagaataatgaatattaaatgagtaaagaaaagtgcttggtgcgtaaaagacataccaataaattttagtcatcgttgttactgcaggactctaggaaatgtgtttgattctcgagatacagccctgagaattaggcattatttgtaaaatgagaacactgaagcccagagagatgatttgcccaagggtactgtgtcagagccctgactccaacttagataaacctgattccgttttatgacttccagtacacagactattttctgagcacctcaaatccccataactgaccctttgcccaaagaggtacatgaaactgtcagtaatttcccccctctaacctttgagtgttccaagtgtttcttcctttcttttattgtagaagcactggatttattgagtgaataaacttaatatagcttgccagccataactttatattagaatagtttggcttgcctcagtgcttggaaataggggtggagtcctcaaatgtccccccacatccaagtcaacagttcatctcttctctctaccaaaagcttgaacgtctctcagcatttttggaagcataaggaaaggttcagaaattagaatacacattccaaaagcacttattcagcacttgctatgtgtattgcttgctatttgcactggagagaaacaagaaaagtaaaactaagagaacttagcatctgattgactgttccctttcttttatcccctatacgtcaaaggtacctaaagcttggaatttatgttatttcaaggatattggttccatcaaatacataatgaagattttgtgaagaaaaagcgatgttgttttgaacattgagagtttgaagttccacctatgggggcattcagattcagcattcccttcaggattggtgcttgggagatagattgagtcatcatttacaaaaaaaaaaaaa

SEQ ID NO: 287092 - DNA, 4015 bp, Homo sapiens
tgacagttagacctggtactaactgacagacacacacagctgcagatgtacttagagtctcatctggttcttaaggagccctaggagcccttgagaaaacaaatgtcaaatgtattagagccactttgggtggagaaattcgagctagacttcgttaaatgcaaggggagcagactgagacttcccccttcccccaactctctgggttgcattccatttagtctttcctagaggcagggaaatgggctaggtggcctttggagcacactgctggcttggtaaatttctgatcttacagatgaaataagaggccttaaaaagtataaggcctttggctcctaagcactaatctgggcaggttagaaagctactcagggctttgggcgaaagccccatatgcccattcagtaagtatataaaaccaggattggcttattgccctcaccattcacgtgcaaatttatcccttcccttcaacattggaaggggcctaaagtgggtgaccccagatttgcgtttcagttctgaagaaaacatgcaagaaaaagaaaatggcgggaggtgctcgcaagctggttcagcccattgccctggatccctcaggacggcctgtgttccccatcggactagggggtctaacagtatatagcctgggggaggtgagtgagaccagcgatatatagagaggagaatcagggaaatacgggaatggggttgagccttccctccctgttcccattagcagcagcctcttgctgatccataccaaccccagcgtatctccagtccctgcaaaaccccaaagtggttctaaaggctaccacaggaaactggacttctaaattcttcagtgacctcaatcccaggttgggggaatgttttttatagatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcagtttgaaattgttcctgaagatgacccccagaatgccattgtcagctcttctgcagatgcttgtcatgcagaactgctcaggactataagcactactatggggaaactaatgcctaacctgcttccagctggagctgacttttttggattttctcatccagccatccacaacctgatccagagctgtccaggagctcgaaaatgcatcaattaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtcaattctgtttactttcatcttgtaatcgggatgtaatcttttttgcttagctctgcctgaggtaaagtaaacttcagcctcttataaacaagagtgatagagagctgcaggctgctacaacaaataccatagacaggttggtttataaataacatgaatttatttctcacagttctggatgctgggaagtccaagttcaaggagcgcagattcaatgtctggtgagggcccacttcctagttcttagacagctgtcttcctgcagtgtcctcacgtggtagaagaggaaggcagctctccggggtcccttttataagatcactaagccggttcatgagaggtctgctctcatgacctaatcacctcccaaaggccccacctcccaataccatcacattaggggttaggatttaacatgaattttggggacatataaacattaagtctgtagtagcagcagctgactaacgagggagatagggagattctgacaaacttctactcttgattgtgatcctaattcaaggaatatcaagtcccagcccctgcaacccaggctgctgcttaattttcatgtcagtatcatcaaaatccaatgttctgcttaaactcaagatggaaagtccagtccaaggtacactgttcatctttttcttcacattttgcacatccttcaaggggatctttaacctctttaacctttgtattgcacctcagataatgtgctttttagctcagtacactgaaaccatatgataacacaaattcacatataattgggggttagtcccatactctataacagacttagtcctgtcttttcattagccatgtaataatataactccatgttccatgcaactggatttttggaccctgttaatagcattaaggtagaggtttactctatcacctaacacctcaacactacctgtgggatgccttagttacccagcagcaggttaccaagggctgtctggaaagggagggacaaaaggacccagaagtagaagaatggggatggagtggtgagaattgaatggttaatgcactgccattcataattgccaattgaggacaacacaaatgggattggtactttatagtaataaatctgaccagcagagggagggatcaggcagcagtgtttagagcacaccacactggccactgtaaactgagaagctaagttaactggtattttatgattttgagtatagtctttttataagttgtatacactttacaatgtaaaagaaacaaactttgtataatagcaaatcgggaaggggactgcttaaaatgttaatgcagtgtttttctttttttctctgcataaatggcttgagcatactggcatttacacagaaatgatatatgctgcttttatcatataacaaatattttcccactattacagcctgagtaatacccgtattaaaagagcctcattttagaaagacatttaaaatttttggaacataccacatgtagaaaggttgaactggtttttcagctataatgcatatacaactatagtgtgtacgtataccacatatacatatacttgtatgaagatatgtgtaaaatgtttttactatggatcatggatttaagaaacttgaaaagctgggcacggtggctcacgcctgtaatcccagcactttgggaggctgaggcgggtggatcaagaggtcaggagatcgagaccatcctggctaagtcggtctctaataaaaatacaaaaaattagccaggcgtggtggcacgcgcctgtagtcccagctactcgggaggctgaggcaggaagaatcgcttgaacccgggaggcagaggttgcagtgagccgagaccgcgccactgcactccagcctgggcaacagagcaaaactccaactcaaaaacaaaaacaaaaacaccttgaaaaacactgccttagtatacttaaactatcttttcatctatcagattgttaaggattttttttaaatttgacaacatccagtgtcaatgagggtgagggcaaaaaaaggactaccttggtgagaatgtaagttgtttaatcctttgggagggttaagctgtagatatctaaattttaaatatatatttatcctcttccatgttaagaaccctaagaaataactggacgagtgtggtatgatgtttgcatgtgatattcattacagtattattttaatagtagaaaattgttaaaaatctatatgtccattaataggaaattggttaaataaaatgaggcttccacaaactgaaaaaaaaaa

SEQ ID NO: 287093 - DNA, 1789 bp, Homo sapiens
ctatagtacccttcagctaagcacacggccgccggccctccctcctctcctcatccagcactagcccccagctgtctctttcctcccggtgcccacgatcgcaccgcccagaccaccctactctccctgccccggaagttacacactgccgacaccgggacgtaacttccgggaagggcttacttccaagacagacacggaagtgctgggaggcgccgggagcccgttcggttgcgggtgtctctggccctgcggtcagccctgggaacgtcccggagagctagattcctagaggcccgattccgctagcccggaacagacaaagccagcgctcccgcccgctccccgacttaggatccgatgccggcagcgtcctggggcccccgtagcggggctggaccatgagcctgctggacggcctcgcttcctcgccgcgggctccgctgcagtccagcaaggccaggatgaaaaagctcccgaagaagagccagaatgagaagtaccggctgaagtacctgcggctgcgcaaagcggccaaggccacggtgtttgaaaatgctgctatttgtgatgaaattgctcgtcttgaggaaaaatttcttaaagcaaaagaagaaagaaggtacttgctaaagaagctcctccagcttcaggctctaactgaaggggaagtacaggctgcagctccttcccacagttccagtttgcccctgacttatggtgtggccagctctgtgggaactatacagggagctgggcctatttcagggcccagcactggggctgaggaaccatttgggaagaaaactaagaaggagaaaaaagaaaaaggcaaagagaacaacaaactggaagccccaaagtggttctaaaggctaccacaggaaactggacttctaaattcttcagtgacctcaatcccaggttgggggaatgttttttatagatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcagtttgaaattgttcctgaagatgacccccagaatgccattgtcagctcttctgcagatgcttgtcatgcagaactgctcaggactataagcactactatggggaaactaatgcctaacctgcttccagctggagctgacttttttggattttctcatccagccatccacaacctgatccagagctgtccaggagctcgaaaatgcatcaattaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtca

SEQ ID NO: 287094 - DNA, 3729 bp, Homo sapiens
tagtgctcgatatcattctaaaaaattatacagaaaataaattaatcctgttcaggataatttgactgaagtaaacattgaagaactagaaactgtttaaatgaactttaaaactagtcaaataatttaattggctagatagaacttgttacagaaatattttcctggcaaaaaaatcattgcgctttatagaaaactggccaaataattaaatcagctagttaacttgttacatttgttacaaaaatattttcttggcaaaaattcctcagaattagtgtaatttcgatgcaacagtttctttttattaacataaccaagatattttaacgttcaaaatgaaagtaaatacaatgaaatggcagtttgcagtcagcctgtttctcctagatcttgtaaaattgacttaaaagattacatggagagtgatctcatttgtttttaaaataccatttgtatttgtacttaaggatataaataagtggattggaaaggtacacaacaaattaaacgctcacttttggaaagctgtcaaccaagaagggtagaactgaaacagtcaaaggactttctctaggtacttggatttgtttcaatttttagcagccctataggaaagtatgtgtgtcccttctgaagatggtatacgtcagcttcacgttccagagtaaagaaatatttacagagtagtatgcccctctctccttccttcttgaggattgatctcattgctcgtttgtctttctcagtttgaaattgttcctgaagatgacccccagaatgccattgtcagctcttctgcagatgcttgtcatgcagaactgctcaggactataagcactactatggggaaactaatgcctaacctgcttccagctggagctgacttttttggattttctcatccagccatccacaacctgatccagagctgtccaggagctcgaaaatgcatcaattaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtcaattctgtttactttcatcttgtaatcgggatgtaatcttttttgcttagctctgcctgaggtaaagtaaacttcagcctcttataaacaagagtgatagagagctgcaggctgctacaacaaataccatagacaggttggtttataaataacatgaatttatttctcacagttctggatgctgggaagtccaagttcaaggagcgcagattcaatgtctggtgagggcccacttcctagttcttagacagctgtcttcctgcagtgtcctcacgtggtagaagaggaaggcagctctccggggtcccttttataagatcactaagccggttcatgagaggtctgctctcatgacctaatcacctcccaaaggccccacctcccaataccatcacattaggggttaggatttaacatgaattttggggacatataaacattaagtctgtagtagcagcagctgactaacgagggagatagggagattctgacaaacttctactcttgattgtgatcctaattcaaggaatatcaagtcccagcccctgcaacccaggctgctgcttaattttcatgtcagtatcatcaaaatccaatgttctgcttaaactcaagatggaaagtccagtccaaggtacactgttcatctttttcttcacattttgcacatccttcaaggggatctttaacctctttaacctttgtattgcacctcagataatgtgctttttagctcagtacactgaaaccatatgataacacaaattcacatataattgggggttagtcccatactctataacagacttagtcctgtcttttcattagccatgtaataatataactccatgttccatgcaactggatttttggaccctgttaatagcattaaggtagaggtttactctatcacctaacacctcaacactacctgtgggatgccttagttacccagcagcaggttaccaagggctgtctggaaagggagggacaaaaggacccagaagtagaagaatggggatggagtggtgagaattgaatggttaatgcactgccattcataattgccaattgaggacaacacaaatgggattggtactttatagtaataaatctgaccagcagagggagggatcaggcagcagtgtttagagcacaccacactggccactgtaaactgagaagctaagttaactggtattttatgattttgagtatagtctttttataagttgtatacactttacaatgtaaaagaaacaaactttgtataatagcaaatcgggaaggggactgcttaaaatgttaatgcagtgtttttctttttttctctgcataaatggcttgagcatactggcatttacacagaaatgatatatgctgcttttatcatataacaaatattttcccactattacagcctgagtaatacccgtattaaaagagcctcattttagaaagacatttaaaatttttggaacataccacatgtagaaaggttgaactggtttttcagctataatgcatatacaactatagtgtgtacgtataccacatatacatatacttgtatgaagatatgtgtaaaatgtttttactatggatcatggatttaagaaacttgaaaagctgggcacggtggctcacgcctgtaatcccagcactttgggaggctgaggcgggtggatcaagaggtcaggagatcgagaccatcctggctaagtcggtctctaataaaaatacaaaaaattagccaggcgtggtggcacgcgcctgtagtcccagctactcgggaggctgaggcaggaagaatcgcttgaacccgggaggcagaggttgcagtgagccgagaccgcgccactgcactccagcctgggcaacagagcaaaactccaactcaaaaacaaaaacaaaaacaccttgaaaaacactgccttagtatacttaaactatcttttcatctatcagattgttaaggattttttttaaatttgacaacatccagtgtcaatgagggtgagggcaaaaaaaggactaccttggtgagaatgtaagttgtttaatcctttgggagggttaagctgtagatatctaaattttaaatatatatttatcctcttccatgttaagaaccctaagaaataactggacgagtgtggtatgatgtttgcatgtgatattcattacagtattattttaatagtagaaaattgttaaaaatctatatgtccattaataggaaattggttaaataaaatgaggcttccacaaactgaaaaaaaaaa

SEQ ID NO: 287095 - DNA, 2711 bp, Homo sapiens
tgaaaggacatgtatatgtctgaccaaaacagtctgcccagactcccgagcagcagtggaacttaaggaattgttttctccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtcaattctgtttactttcatcttgtaatcgggatgtaatcttttttgcttagctctgcctgaggtaaagtaaacttcagcctcttataaacaagagtgatagagagctgcaggctgctacaacaaataccatagacaggttggtttataaataacatgaatttatttctcacagttctggatgctgggaagtccaagttcaaggagcgcagattcaatgtctggtgagggcccacttcctagttcttagacagctgtcttcctgcagtgtcctcacgtggtagaagaggaaggcagctctccggggtcccttttataagatcactaagccggttcatgagaggtctgctctcatgacctaatcacctcccaaaggccccacctcccaataccatcacattaggggttaggatttaacatgaattttggggacatataaacattaagtctgtagtagcagcagctgactaacgagggagatagggagattctgacaaacttctactcttgattgtgatcctaattcaaggaatatcaagtcccagcccctgcaacccaggctgctgcttaattttcatgtcagtatcatcaaaatccaatgttctgcttaaactcaagatggaaagtccagtccaaggtacactgttcatctttttcttcacattttgcacatccttcaaggggatctttaacctctttaacctttgtattgcacctcagataatgtgctttttagctcagtacactgaaaccatatgataacacaaattcacatataattgggggttagtcccatactctataacagacttagtcctgtcttttcattagccatgtaataatataactccatgttccatgcaactggatttttggaccctgttaatagcattaaggtagaggtttactctatcacctaacacctcaacactacctgtgggatgccttagttacccagcagcaggttaccaagggctgtctggaaagggagggacaaaaggacccagaagtagaagaatggggatggagtggtgagaattgaatggttaatgcactgccattcataattgccaattgaggacaacacaaatgggattggtactttatagtaataaatctgaccagcagagggagggatcaggcagcagtgtttagagcacaccacactggccactgtaaactgagaagctaagttaactggtattttatgattttgagtatagtctttttataagttgtatacactttacaatgtaaaagaaacaaactttgtataatagcaaatcgggaaggggactgcttaaaatgttaatgcagtgtttttctttttttctctgcataaatggcttgagcatactggcatttacacagaaatgatatatgctgcttttatcatataacaaatattttcccactattacagcctgagtaatacccgtattaaaagagcctcattttagaaagacatttaaaatttttggaacataccacatgtagaaaggttgaactggtttttcagctataatgcatatacaactatagtgtgtacgtataccacatatacatatacttgtatgaagatatgtgtaaaatgtttttactatggatcatggatttaagaaacttgaaaagctgggcacggtggctcacgcctgtaatcccagcactttgggaggctgaggcgggtggatcaagaggtcaggagatcgagaccatcctggctaagtcggtctctaataaaaatacaaaaaattagccaggcgtggtggcacgcgcctgtagtcccagctactcgggaggctgaggcaggaagaatcgcttgaacccgggaggcagaggttgcagtgagccgagaccgcgccactgcactccagcctgggcaacagagcaaaactccaactcaaaaacaaaaacaaaaacaccttgaaaaacactgccttagtatacttaaactatcttttcatctatcagattgttaaggattttttttaaatttgacaacatccagtgtcaatgagggtgagggcaaaaaaaggactaccttggtgagaatgtaagttgtttaatcctttgggagggttaagctgtagatatctaaattttaaatatatatttatcctcttccatgttaagaaccctaagaaataactggacgagtgtggtatgatgtttgcatgtgatattcattacagtattattttaatagtagaaaattgttaaaaatctatatgtccattaataggaaattggttaaataaaatgaggcttccacaaactgaaaaaaaaaa

SEQ ID NO: 287096 - DNA, 1012 bp, Homo sapiens
  misc_feature (255)..(255): n is a, c, g, or t
  misc_feature (259)..(259): n is a, c, g, or t
  misc_feature (267)..(267): n is a, c, g, or t
  misc_feature (269)..(269): n is a, c, g, or t
  misc_feature (273)..(273): n is a, c, g, or t
gtaaatgatgactcaatctatctcccaagcaccaatcctgaagggaatgctgaatctgaatgcccccataggtggaacttcaaactctcaatgttcaaaacaacatcgctttttcttcacaaaatcttcattatgtatttgatggaaccaatatccttgaaataacataaattccaagctttaggtacctttgacgtataggggataaaagaaagggaacagtcaatcagatgctaagttctcttagttttactntttnctgtggtntntctncccccttttcccttttttcagtgcaaatagcaagcaatacacatagcaagtgctgaataagtgcttttggaatgtgtattctaatttctgaccctttgcccaaagaggtacatgaaactgtcagtaatttcccccctctaacctttgagtgttccaagtgtttcttcctttcttttattgtagaagcactggatttattgagtgaataaacttaatatagcttgccagccataactttatattagaatagtttggcttgcctcagtgcttggaaataggggtggagtcctcaaatgtccccccacatccaagtcaacagttcatctcttctctctaccaaaagcttgaacgtctctcagcatttttggaagcataaggaaaggttcagaaattagaatacacattccaaaagcacttattcagcacttgctatgtgtattgcttgctatttgcactggagagaaacaagaaaagtaaaactaagagaacttagcatctgattgactgttccctttcttttatcccctatacgtcaaaggtacctaaagcttggaatttatgttatttcaaggatattggttccatcaaatacataatgaagattttgtgaagaaaaagcgatgttgttttgaacattgagagtttgaagttccacctatgggggcattcagattcagcattcccttcaggattggtgcttgggagatagattgagtcatcatttacaaaaaaaaaaaaa

SEQ ID NO: 287097 - DNA, 1553 bp, Homo sapiens
tagccatgtaataatataaagacaggactaagtctgttatagagtatgggactaacccccaattctataacagacttagtcctgtcttttcattagccatgtaataatataactccatgttccatgcaactggatttttggaccctgttaatagcattaaggtagaggtttactctatcacctaacacctcaacactacctgtgggatgccttagttacccagcagcaggttaccaagggctgtctggaaagggagggacaaaaggacccagaagtagaagaatggggatggagtggtgagaattgaatggttaatgcactgccattcataattgccaattgaggacaacacaaatgggattggtactttatagtaataaatctgaccagcagagggagggatcaggcagcagtgtttagagcacaccacactggccactgtaaactgagaagctaagttaactggtattttatgattttgagtatagtctttttataagttgtatacactttacaatgtaaaagaaacaaactttgtataatagcaaatcgggaaggggactgcttaaaatgttaatgcagtgtttttctttttttctctgcataaatggcttgagcatactggcatttacacagaaatgatatatgctgcttttatcatataacaaatattttcccactattacagcctgagtaatacccgtattaaaagagcctcattttagaaagacatttaaaatttttggaacataccacatgtagaaaggttgaactggtttttcagctataatgcatatacaactatagtgtgtacgtataccacatatacatatacttgtatgaagatatgtgtaaaatgtttttactatggatcatggatttaagaaacttgaaaagctgggcacggtggctcacgcctgtaatcccagcactttgggaggctgaggcgggtggatcaagaggtcaggagatcgagaccatcctggctaagtcggtctctaataaaaatacaaaaaattagccaggcgtggtggcacgcgcctgtagtcccagctactcgggaggctgaggcaggaagaatcgcttgaacccgggaggcagaggttgcagtgagccgagaccgcgccactgcactccagcctgggcaacagagcaaaactccaactcaaaaacaaaaacaaaaacaccttgaaaaacactgccttagtatacttaaactatcttttcatctatcagattgttaaggattttttttaaatttgacaacatccagtgtcaatgagggtgagggcaaaaaaaggactaccttggtgagaatgtaagttgtttaatcctttgggagggttaagctgtagatatctaaattttaaatatatatttatcctcttccatgttaagaaccctaagaaataactggacgagtgtggtatgatgtttgcatgtgatattcattacagtattattttaatagtagaaaattgttaaaaatctatatgtccattaataggaaattggttaaataaaatgaggcttccacaaactgaaaaaaaaaa

SEQ ID NO: 287098 - DNA, 752 bp, Homo sapiens
ctatagtacccttcagctaagcacacggccgccggccctccctcctctcctcatccagcactagcccccagctgtctctttcctcccggtgcccacgatcgcaccgcccagaccaccctactctccctgccccggaagttacacactgccgacaccgggacgtaacttccgggaagggcttacttccaagacagacacggaagtgctgggaggcgccgggagcccgttcggttgcgggtgtctctggccctgcggtcagccctgggaacgtcccggagagctagattcctagaggcccgattccgctagcccggaacagacaaagccagcgctcccgcccgctccccgacttaggatccgatgccggcagcgtcctggggcccccgtagcggggctggaccatgagcctgctggacggcctcgcttcctcgccgcgggctccgctgcagtccagcaaggccaggatgaaaaagctcccgaagaagagccagaatgagaagtaccggctgaagtacctgcggctgcgcaaagcggccaaggccacggtgtttgtacctaaagcttggaatttatgttatttcaaggatattggttccatcaaatacataatgaagattttgtgaagaaaaagcgatgttgttttgaacattgagagtttgaagttccacctatgggggcattcagattcagcattcccttcaggattggtgcttgggagatagattgagtcatcatttacaaaaaaaaaaaaa

SEQ ID NO: 287099 - DNA, 789 bp, Homo sapiens
agaaaaccaccattgattgaaaccactcacaagagaatttattactgacaaaattgacagatctctaaaatttgacacggtaaattgaatccagtgaaataataaccacagaagaaaactaacagtagtggaaactatactcagtaaaaattgctttgactttttttagaaatcagtagtgctcgatatcattctaaaaaattatacagaaaataaattaatcctgttcaggataatttgactgaagtaaacattgaagaactagaaactgtttaaatgaactttaaaactagtcaaataatttaattggctagatagaacttgttacagaaatattttcctggcaaaaaaatcattgcgctttatagaaaactggccaaataattaaatcagctagttaacttgttacatttgttacaaaaatattttcttggcaaaaattcctcagaattagtgtaatttcgatgcaacagtttctttttattaacataaccaagatattttaacgttcaaaatgaaagtaaatacaatgaaatggcagtttgcagtcagcctgtttctcctagatcttgtaaaattgacttaaaagattacatggagagtgatctcatttgtttttaaaataccatttgtatttgtacttaaggatataaataagtggattggaaaggtacacaacaaattaaacgctcacttttggaaagctgtcaaccaagaagggtagaactgaaacagtcaaaggactttctctaggtacttggatttgtttcaatttttagcagccctata

SEQ ID NO: 287100 - DNA, 604 bp, Homo sapiens
catttagtctttcctagaggcagggaaatgggctaggtggcctttggagcacactgctggcttggtaaatttctgatcttacagatgaaataagaggccttaaaaagtataaggcctttggctcctaagcactaatctgggcaggttagaaagctactcagggctttgggcgaaagccccatatgcccattcagtaagtatataaaaccaggattggcttattgccctcaccattcacgtgcaaatttatcccttcccttcaacattggaaggggcctaaagtgggtgaccccagatttgcgtttcagttctgaagaaaacatgcaagaaaaagaaaatggcgggaggtgctcgcaagctggttcagcccattgccctggatccctcaggacggcctgtgttccccatcggactagggggtctaacagtatatagcctgggggaggtgagtgagaccagcgatatatagagaggagaatcagggaaatacgggaatggggttgagccttccctccctgttcccattagcagcagcctcttgctgatccataccaaccccagcgtatctccagtccctgcaaaaccaggtcagtgttgtctgcta

SEQ ID NO: 287101 - DNA, 651 bp, Homo sapiens
cgttccagagtaaagaaatatttacagagtagtatgcccctctctccttccttcttgaggattgatctcattgctcgtttgtctttctcagtttgaaattgttcctgaagatgacccccagaatgccattgtcagctcttctgcagatgcttgtcatgcagaactgctcaggactataagcactactatgtaagttgaccaaaagcttgaaaacaggctaaaagatcactgttggtacagtgaaaccttttctcttgcttttaatgggtggagatactttattttatagaaacctatcctggatcctcctgacattgtgccaactagagcctccacattatcaaagtcaagaaagcttatcctgtttgttcataccactattctgttcttaaatccatcttcatctcccgctaagctctcaaactaaaattatccctctcctgtttagggggaaactaatgcctaacctgcttccagctggagctgacttttttggattttctcatccagccatccacaacctgatccagagctgtccaggagctcgaaaatgcatcaagtaagtgtgatcaaattcattcccttgagaaaagctcagtgatcatccggccagggactggcagttcctactttgttcactgaccttctgtg

SEQ ID NO: 287102 - DNA, 3982 bp, Homo sapiens
ctatagtacccttcagctaagcacacggccgccggccctccctcctctcctcatccagcactagcccccagctgtctctttcctcccggtgcccacgatcgcaccgcccagaccaccctactctccctgccccggaagttacacactgccgacaccgggacgtaacttccgggaagggcttacttccaagacagacacggaagtgctgggaggcgccgggagcccgttcggttgcgggtgtctctggccctgcggtcagccctgggaacgtcccggagagctagattcctagaggcccgattccgctagcccggaacagacaaagccagcgctcccgcccgctccccgacttaggatccgatgccggcagcgtcctggggcccccgtagcggggctggaccatgagcctgctggacggcctcgcttcctcgccgcgggctccgctgcagtccagcaaggccaggatgaaaaagctcccgaagaagagccagaatgagaagtaccggctgaagtacctgcggctgcgcaaagcggccaaggccacggtgtttgaaaatgctgctatttgtgatgaaattgctcgtcttgaggaaaaatttcttaaagcaaaagaagaaagaaggtacttgctaaagaagctcctccagcttcaggctctaactgaaggggaagtacaggctgcagctccttcccacagttccagtttgcccctgacttatggtgtggccagctctgtgggaactatacagggagctgggcctatttcagggcccagcactggggctgaggaaccatttgggaagaaaactaagaaggagaaaaaagaaaaaggcaaagagaacaacaaactggaagatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcagtttgaaattgttcctgaagatgacccccagaatgccattgtcagctcttctgcagatgcttgtcatgcagaactgctcaggactataagcactactatggggaaactaatgcctaacctgcttccagctggagctgacttttttggattttctcatccagccatccacaacctgatccagagctgtccaggagctcgaaaatgcatcaattaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtcaattctgtttactttcatcttgtaatcgggatgtaatcttttttgcttagctctgcctgaggtaaagtaaacttcagcctcttataaacaagagtgatagagagctgcaggctgctacaacaaataccatagacaggttggtttataaataacatgaatttatttctcacagttctggatgctgggaagtccaagttcaaggagcgcagattcaatgtctggtgagggcccacttcctagttcttagacagctgtcttcctgcagtgtcctcacgtggtagaagaggaaggcagctctccggggtcccttttataagatcactaagccggttcatgagaggtctgctctcatgacctaatcacctcccaaaggccccacctcccaataccatcacattaggggttaggatttaacatgaattttggggacatataaacattaagtctgtagtagcagcagctgactaacgagggagatagggagattctgacaaacttctactcttgattgtgatcctaattcaaggaatatcaagtcccagcccctgcaacccaggctgctgcttaattttcatgtcagtatcatcaaaatccaatgttctgcttaaactcaagatggaaagtccagtccaaggtacactgttcatctttttcttcacattttgcacatccttcaaggggatctttaacctctttaacctttgtattgcacctcagataatgtgctttttagctcagtacactgaaaccatatgataacacaaattcacatataattgggggttagtcccatactctataacagacttagtcctgtcttttcattagccatgtaataatataactccatgttccatgcaactggatttttggaccctgttaatagcattaaggtagaggtttactctatcacctaacacctcaacactacctgtgggatgccttagttacccagcagcaggttaccaagggctgtctggaaagggagggacaaaaggacccagaagtagaagaatggggatggagtggtgagaattgaatggttaatgcactgccattcataattgccaattgaggacaacacaaatgggattggtactttatagtaataaatctgaccagcagagggagggatcaggcagcagtgtttagagcacaccacactggccactgtaaactgagaagctaagttaactggtattttatgattttgagtatagtctttttataagttgtatacactttacaatgtaaaagaaacaaactttgtataatagcaaatcgggaaggggactgcttaaaatgttaatgcagtgtttttctttttttctctgcataaatggcttgagcatactggcatttacacagaaatgatatatgctgcttttatcatataacaaatattttcccactattacagcctgagtaatacccgtattaaaagagcctcattttagaaagacatttaaaatttttggaacataccacatgtagaaaggttgaactggtttttcagctataatgcatatacaactatagtgtgtacgtataccacatatacatatacttgtatgaagatatgtgtaaaatgtttttactatggatcatggatttaagaaacttgaaaagctgggcacggtggctcacgcctgtaatcccagcactttgggaggctgaggcgggtggatcaagaggtcaggagatcgagaccatcctggctaagtcggtctctaataaaaatacaaaaaattagccaggcgtggtggcacgcgcctgtagtcccagctactcgggaggctgaggcaggaagaatcgcttgaacccgggaggcagaggttgcagtgagccgagaccgcgccactgcactccagcctgggcaacagagcaaaactccaactcaaaaacaaaaacaaaaacaccttgaaaaacactgccttagtatacttaaactatcttttcatctatcagattgttaaggattttttttaaatttgacaacatccagtgtcaatgagggtgagggcaaaaaaaggactaccttggtgagaatgtaagttgtttaatcctttgggagggttaagctgtagatatctaaattttaaatatatatttatcctcttccatgttaagaaccctaagaaataactggacgagtgtggtatgatgtttgcatgtgatattcattacagtattattttaatagtagaaaattgttaaaaatctatatgtccattaataggaaattggttaaataaaatgaggcttccacaaactgaaaaaaaaaa

SEQ ID NO: 287103 - DNA, 4119 bp, Homo sapiens
ctatagtacccttcagctaagcacacggccgccggccctccctcctctcctcatccagcactagcccccagctgtctctttcctcccggtgcccacgatcgcaccgcccagaccaccctactctccctgccccggaagttacacactgccgacaccgggacgtaacttccgggaagggcttacttccaagacagacacggaagtgctgggaggcgccgggagcccgttcggttgcgggtgtctctggccctgcggtcagccctgggaacgtcccggagagctagattcctagaggcccgattccgctagcccggaacagacaaagccagcgctcccgcccgctccccgacttaggatccgatgccggcagcgtcctggggcccccgtagcggggctggaccatgagcctgctggacggcctcgcttcctcgccgcgggctccgctgcagtccagcaaggccaggatgaaaaagctcccgaagaagagccagaatgagaagtaccggctgaagtacctgcggctgcgcaaagcggccaaggccacggtgtttgaaaatgctgctatttgtgatgaaattgctcgtcttgaggaaaaatttcttaaagcaaaagaagaaagaaggtacttgctaaagaagctcctccagcttcaggctctaactgaaggggaagtacaggctgcagctccttcccacagttccagtttgcccctgacttatggtgtggccagctctgtgggaactatacagggagctgggcctatttcagggcccagcactggggctgaggaaccatttgggaagaaaactaagaaggagaaaaaagaaaaaggcaaagagaacaacaaactggaagttctgaagaaaacatgcaagaaaaagaaaatggcgggaggtgctcgcaagctggttcagcccattgccctggatccctcaggacggcctgtgttccccatcggactagggggtctaacagtatatagcctgggggagatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcagtttgaaattgttcctgaagatgacccccagaatgccattgtcagctcttctgcagatgcttgtcatgcagaactgctcaggactataagcactactatggggaaactaatgcctaacctgcttccagctggagctgacttttttggattttctcatccagccatccacaacctgatccagagctgtccaggagctcgaaaatgcatcaattaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtcaattctgtttactttcatcttgtaatcgggatgtaatcttttttgcttagctctgcctgaggtaaagtaaacttcagcctcttataaacaagagtgatagagagctgcaggctgctacaacaaataccatagacaggttggtttataaataacatgaatttatttctcacagttctggatgctgggaagtccaagttcaaggagcgcagattcaatgtctggtgagggcccacttcctagttcttagacagctgtcttcctgcagtgtcctcacgtggtagaagaggaaggcagctctccggggtcccttttataagatcactaagccggttcatgagaggtctgctctcatgacctaatcacctcccaaaggccccacctcccaataccatcacattaggggttaggatttaacatgaattttggggacatataaacattaagtctgtagtagcagcagctgactaacgagggagatagggagattctgacaaacttctactcttgattgtgatcctaattcaaggaatatcaagtcccagcccctgcaacccaggctgctgcttaattttcatgtcagtatcatcaaaatccaatgttctgcttaaactcaagatggaaagtccagtccaaggtacactgttcatctttttcttcacattttgcacatccttcaaggggatctttaacctctttaacctttgtattgcacctcagataatgtgctttttagctcagtacactgaaaccatatgataacacaaattcacatataattgggggttagtcccatactctataacagacttagtcctgtcttttcattagccatgtaataatataactccatgttccatgcaactggatttttggaccctgttaatagcattaaggtagaggtttactctatcacctaacacctcaacactacctgtgggatgccttagttacccagcagcaggttaccaagggctgtctggaaagggagggacaaaaggacccagaagtagaagaatggggatggagtggtgagaattgaatggttaatgcactgccattcataattgccaattgaggacaacacaaatgggattggtactttatagtaataaatctgaccagcagagggagggatcaggcagcagtgtttagagcacaccacactggccactgtaaactgagaagctaagttaactggtattttatgattttgagtatagtctttttataagttgtatacactttacaatgtaaaagaaacaaactttgtataatagcaaatcgggaaggggactgcttaaaatgttaatgcagtgtttttctttttttctctgcataaatggcttgagcatactggcatttacacagaaatgatatatgctgcttttatcatataacaaatattttcccactattacagcctgagtaatacccgtattaaaagagcctcattttagaaagacatttaaaatttttggaacataccacatgtagaaaggttgaactggtttttcagctataatgcatatacaactatagtgtgtacgtataccacatatacatatacttgtatgaagatatgtgtaaaatgtttttactatggatcatggatttaagaaacttgaaaagctgggcacggtggctcacgcctgtaatcccagcactttgggaggctgaggcgggtggatcaagaggtcaggagatcgagaccatcctggctaagtcggtctctaataaaaatacaaaaaattagccaggcgtggtggcacgcgcctgtagtcccagctactcgggaggctgaggcaggaagaatcgcttgaacccgggaggcagaggttgcagtgagccgagaccgcgccactgcactccagcctgggcaacagagcaaaactccaactcaaaaacaaaaacaaaaacaccttgaaaaacactgccttagtatacttaaactatcttttcatctatcagattgttaaggattttttttaaatttgacaacatccagtgtcaatgagggtgagggcaaaaaaaggactaccttggtgagaatgtaagttgtttaatcctttgggagggttaagctgtagatatctaaattttaaatatatatttatcctcttccatgttaagaaccctaagaaataactggacgagtgtggtatgatgtttgcatgtgatattcattacagtattattttaatagtagaaaattgttaaaaatctatatgtccattaataggaaattggttaaataaaatgaggcttccacaaactgaaaaaaaaaa

SEQ ID NO: 287104 - DNA, 4037 bp, Homo sapiens
ctatagtacccttcagctaagcacacggccgccggccctccctcctctcctcatccagcactagcccccagctgtctctttcctcccggtgcccacgatcgcaccgcccagaccaccctactctccctgccccggaagttacacactgccgacaccgggacgtaacttccgggaagggcttacttccaagacagacacggaagtgctgggaggcgccgggagcccgttcggttgcgggtgtctctggccctgcggtcagccctgggaacgtcccggagagctagattcctagaggcccgattccgctagcccggaacagacaaagccagcgctcccgcccgctccccgacttaggatccgatgccggcagcgtcctggggcccccgtagcggggctggaccatgagcctgctggacggcctcgcttcctcgccgcgggctccgctgcagtccagcaaggccaggatgaaaaagctcccgaagaagagccagaatgagaagtaccggctgaagtacctgcggctgcgcaaagcggccaaggccacggtgtttgaaaatgctgctatttgtgatgaaattgctcgtcttgaggaaaaatttcttaaagcaaaagaagaaagaaggtacttgctaaagaagctcctccagcttcaggctctaactgaaggggaagtacaggctgcagctccttcccacagttccagtttgcccctgacttatggtgtggccagctctgtgggaactatacagggagctgggcctatttcagggcccagcactggggctgaggaaccatttgggaagaaaactaagaaggagaaaaaagaaaaaggcaaagagaacaacaaactggaagcagcagcctcttgctgatccataccaaccccagcgtatctccagtccctgcaaaaatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcagtttgaaattgttcctgaagatgacccccagaatgccattgtcagctcttctgcagatgcttgtcatgcagaactgctcaggactataagcactactatggggaaactaatgcctaacctgcttccagctggagctgacttttttggattttctcatccagccatccacaacctgatccagagctgtccaggagctcgaaaatgcatcaattaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtcaattctgtttactttcatcttgtaatcgggatgtaatcttttttgcttagctctgcctgaggtaaagtaaacttcagcctcttataaacaagagtgatagagagctgcaggctgctacaacaaataccatagacaggttggtttataaataacatgaatttatttctcacagttctggatgctgggaagtccaagttcaaggagcgcagattcaatgtctggtgagggcccacttcctagttcttagacagctgtcttcctgcagtgtcctcacgtggtagaagaggaaggcagctctccggggtcccttttataagatcactaagccggttcatgagaggtctgctctcatgacctaatcacctcccaaaggccccacctcccaataccatcacattaggggttaggatttaacatgaattttggggacatataaacattaagtctgtagtagcagcagctgactaacgagggagatagggagattctgacaaacttctactcttgattgtgatcctaattcaaggaatatcaagtcccagcccctgcaacccaggctgctgcttaattttcatgtcagtatcatcaaaatccaatgttctgcttaaactcaagatggaaagtccagtccaaggtacactgttcatctttttcttcacattttgcacatccttcaaggggatctttaacctctttaacctttgtattgcacctcagataatgtgctttttagctcagtacactgaaaccatatgataacacaaattcacatataattgggggttagtcccatactctataacagacttagtcctgtcttttcattagccatgtaataatataactccatgttccatgcaactggatttttggaccctgttaatagcattaaggtagaggtttactctatcacctaacacctcaacactacctgtgggatgccttagttacccagcagcaggttaccaagggctgtctggaaagggagggacaaaaggacccagaagtagaagaatggggatggagtggtgagaattgaatggttaatgcactgccattcataattgccaattgaggacaacacaaatgggattggtactttatagtaataaatctgaccagcagagggagggatcaggcagcagtgtttagagcacaccacactggccactgtaaactgagaagctaagttaactggtattttatgattttgagtatagtctttttataagttgtatacactttacaatgtaaaagaaacaaactttgtataatagcaaatcgggaaggggactgcttaaaatgttaatgcagtgtttttctttttttctctgcataaatggcttgagcatactggcatttacacagaaatgatatatgctgcttttatcatataacaaatattttcccactattacagcctgagtaatacccgtattaaaagagcctcattttagaaagacatttaaaatttttggaacataccacatgtagaaaggttgaactggtttttcagctataatgcatatacaactatagtgtgtacgtataccacatatacatatacttgtatgaagatatgtgtaaaatgtttttactatggatcatggatttaagaaacttgaaaagctgggcacggtggctcacgcctgtaatcccagcactttgggaggctgaggcgggtggatcaagaggtcaggagatcgagaccatcctggctaagtcggtctctaataaaaatacaaaaaattagccaggcgtggtggcacgcgcctgtagtcccagctactcgggaggctgaggcaggaagaatcgcttgaacccgggaggcagaggttgcagtgagccgagaccgcgccactgcactccagcctgggcaacagagcaaaactccaactcaaaaacaaaaacaaaaacaccttgaaaaacactgccttagtatacttaaactatcttttcatctatcagattgttaaggattttttttaaatttgacaacatccagtgtcaatgagggtgagggcaaaaaaaggactaccttggtgagaatgtaagttgtttaatcctttgggagggttaagctgtagatatctaaattttaaatatatatttatcctcttccatgttaagaaccctaagaaataactggacgagtgtggtatgatgtttgcatgtgatattcattacagtattattttaatagtagaaaattgttaaaaatctatatgtccattaataggaaattggttaaataaaatgaggcttccacaaactgaaaaaaaaaa

SEQ ID NO: 287105 - DNA, 4209 bp, Homo sapiens
ctatagtacccttcagctaagcacacggccgccggccctccctcctctcctcatccagcactagcccccagctgtctctttcctcccggtgcccacgatcgcaccgcccagaccaccctactctccctgccccggaagttacacactgccgacaccgggacgtaacttccgggaagggcttacttccaagacagacacggaagtgctgggaggcgccgggagcccgttcggttgcgggtgtctctggccctgcggtcagccctgggaacgtcccggagagctagattcctagaggcccgattccgctagcccggaacagacaaagccagcgctcccgcccgctccccgacttaggatccgatgccggcagcgtcctggggcccccgtagcggggctggaccatgagcctgctggacggcctcgcttcctcgccgcgggctccgctgcagtccagcaaggccaggatgaaaaagctcccgaagaagagccagaatgagaagtaccggctgaagtacctgcggctgcgcaaagcggccaaggccacggtgtttgaaaatgctgctatttgtgatgaaattgctcgtcttgaggaagagtcagaatgagaagtagcaggatgaagtgatctgcggttggcagatgcggccaaggtcagggtgtatgagaatgctgctatttgtgagtgaaatttgtctcgtacttgatggaaaaatgtccttaggagctatagagtagtgagaagaggtgttgtggtagtggtacttgctaaagaagctcctccagcttcaggctctaactgaaggggaagtacaggctgcagctccttcccacagttccagtttgcccctgacttatggtgtggccagctctgtgggaactatacagggagctgggcctatttcagggcccagcactggggctgaggaaccatttgggaagaaaactaagaaggagaaaaaagaaaaaggcaaagagaacaacaaactggaagccccaaagtggttctaaaggctaccacaggaaactggacttctaaattcttcagtgacctcaatcccaggttgggggaatgttttttatagatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcagtttgaaattgttcctgaagatgacccccagaatgccattgtcagctcttctgcagatgcttgtcatgcagaactgctcaggactataagcactactatggggaaactaatgcctaacctgcttccagctggagctgacttttttggattttctcatccagccatccacaacctgatccagagctgtccaggagctcgaaaatgcatcaattaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtcaattctgtttactttcatcttgtaatcgggatgtaatcttttttgcttagctctgcctgaggtaaagtaaacttcagcctcttataaacaagagtgatagagagctgcaggctgctacaacaaataccatagacaggttggtttataaataacatgaatttatttctcacagttctggatgctgggaagtccaagttcaaggagcgcagattcaatgtctggtgagggcccacttcctagttcttagacagctgtcttcctgcagtgtcctcacgtggtagaagaggaaggcagctctccggggtcccttttataagatcactaagccggttcatgagaggtctgctctcatgacctaatcacctcccaaaggccccacctcccaataccatcacattaggggttaggatttaacatgaattttggggacatataaacattaagtctgtagtagcagcagctgactaacgagggagatagggagattctgacaaacttctactcttgattgtgatcctaattcaaggaatatcaagtcccagcccctgcaacccaggctgctgcttaattttcatgtcagtatcatcaaaatccaatgttctgcttaaactcaagatggaaagtccagtccaaggtacactgttcatctttttcttcacattttgcacatccttcaaggggatctttaacctctttaacctttgtattgcacctcagataatgtgctttttagctcagtacactgaaaccatatgataacacaaattcacatataattgggggttagtcccatactctataacagacttagtcctgtcttttcattagccatgtaataatataactccatgttccatgcaactggatttttggaccctgttaatagcattaaggtagaggtttactctatcacctaacacctcaacactacctgtgggatgccttagttacccagcagcaggttaccaagggctgtctggaaagggagggacaaaaggacccagaagtagaagaatggggatggagtggtgagaattgaatggttaatgcactgccattcataattgccaattgaggacaacacaaatgggattggtactttatagtaataaatctgaccagcagagggagggatcaggcagcagtgtttagagcacaccacactggccactgtaaactgagaagctaagttaactggtattttatgattttgagtatagtctttttataagttgtatacactttacaatgtaaaagaaacaaactttgtataatagcaaatcgggaaggggactgcttaaaatgttaatgcagtgtttttctttttttctctgcataaatggcttgagcatactggcatttacacagaaatgatatatgctgcttttatcatataacaaatattttcccactattacagcctgagtaatacccgtattaaaagagcctcattttagaaagacatttaaaatttttggaacataccacatgtagaaaggttgaactggtttttcagctataatgcatatacaactatagtgtgtacgtataccacatatacatatacttgtatgaagatatgtgtaaaatgtttttactatggatcatggatttaagaaacttgaaaagctgggcacggtggctcacgcctgtaatcccagcactttgggaggctgaggcgggtggatcaagaggtcaggagatcgagaccatcctggctaagtcggtctctaataaaaatacaaaaaattagccaggcgtggtggcacgcgcctgtagtcccagctactcgggaggctgaggcaggaagaatcgcttgaacccgggaggcagaggttgcagtgagccgagaccgcgccactgcactccagcctgggcaacagagcaaaactccaactcaaaaacaaaaacaaaaacaccttgaaaaacactgccttagtatacttaaactatcttttcatctatcagattgttaaggattttttttaaatttgacaacatccagtgtcaatgagggtgagggcaaaaaaaggactaccttggtgagaatgtaagttgtttaatcctttgggagggttaagctgtagatatctaaattttaaatatatatttatcctcttccatgttaagaaccctaagaaataactggacgagtgtggtatgatgtttgcatgtgatattcattacagtattattttaatagtagaaaattgttaaaaatctatatgtccattaataggaaattggttaaataaaatgaggcttccacaaactgaaaaaaaaaa

SEQ ID NO: 287106 - DNA, 3392 bp, Homo sapiens
  misc_feature (52)..(52): n is a, c, g, or t
ttactgagggagacagcgcgccctccacgtccattgccctactttgtttgcngtttgtggacaaacagggagctgggcctatttcagggcccagcactggggctgaggaaccatttgggaagaaaactaagaaggagaaaaaagaaaaaggcaaagagaacaacaaactggaagccccaaagtggttctaaaggctaccacaggaaactggacttctaaattcttcagtgacctcaatcccaggttgggggaatgttttttatagatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcagtttgaaattgttcctgaagatgacccccagaatgccattgtcagctcttctgcagatgcttgtcatgcagaactgctcaggactataagcactactatggggaaactaatgcctaacctgcttccagctggagctgacttttttggattttctcatccagccatccacaacctgatccagagctgtccaggagctcgaaaatgcatcaattaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtcaattctgtttactttcatcttgtaatcgggatgtaatcttttttgcttagctctgcctgaggtaaagtaaacttcagcctcttataaacaagagtgatagagagctgcaggctgctacaacaaataccatagacaggttggtttataaataacatgaatttatttctcacagttctggatgctgggaagtccaagttcaaggagcgcagattcaatgtctggtgagggcccacttcctagttcttagacagctgtcttcctgcagtgtcctcacgtggtagaagaggaaggcagctctccggggtcccttttataagatcactaagccggttcatgagaggtctgctctcatgacctaatcacctcccaaaggccccacctcccaataccatcacattaggggttaggatttaacatgaattttggggacatataaacattaagtctgtagtagcagcagctgactaacgagggagatagggagattctgacaaacttctactcttgattgtgatcctaattcaaggaatatcaagtcccagcccctgcaacccaggctgctgcttaattttcatgtcagtatcatcaaaatccaatgttctgcttaaactcaagatggaaagtccagtccaaggtacactgttcatctttttcttcacattttgcacatccttcaaggggatctttaacctctttaacctttgtattgcacctcagataatgtgctttttagctcagtacactgaaaccatatgataacacaaattcacatataattgggggttagtcccatactctataacagacttagtcctgtcttttcattagccatgtaataatataactccatgttccatgcaactggatttttggaccctgttaatagcattaaggtagaggtttactctatcacctaacacctcaacactacctgtgggatgccttagttacccagcagcaggttaccaagggctgtctggaaagggagggacaaaaggacccagaagtagaagaatggggatggagtggtgagaattgaatggttaatgcactgccattcataattgccaattgaggacaacacaaatgggattggtactttatagtaataaatctgaccagcagagggagggatcaggcagcagtgtttagagcacaccacactggccactgtaaactgagaagctaagttaactggtattttatgattttgagtatagtctttttataagttgtatacactttacaatgtaaaagaaacaaactttgtataatagcaaatcgggaaggggactgcttaaaatgttaatgcagtgtttttctttttttctctgcataaatggcttgagcatactggcatttacacagaaatgatatatgctgcttttatcatataacaaatattttcccactattacagcctgagtaatacccgtattaaaagagcctcattttagaaagacatttaaaatttttggaacataccacatgtagaaaggttgaactggtttttcagctataatgcatatacaactatagtgtgtacgtataccacatatacatatacttgtatgaagatatgtgtaaaatgtttttactatggatcatggatttaagaaacttgaaaagctgggcacggtggctcacgcctgtaatcccagcactttgggaggctgaggcgggtggatcaagaggtcaggagatcgagaccatcctggctaagtcggtctctaataaaaatacaaaaaattagccaggcgtggtggcacgcgcctgtagtcccagctactcgggaggctgaggcaggaagaatcgcttgaacccgggaggcagaggttgcagtgagccgagaccgcgccactgcactccagcctgggcaacagagcaaaactccaactcaaaaacaaaaacaaaaacaccttgaaaaacactgccttagtatacttaaactatcttttcatctatcagattgttaaggattttttttaaatttgacaacatccagtgtcaatgagggtgagggcaaaaaaaggactaccttggtgagaatgtaagttgtttaatcctttgggagggttaagctgtagatatctaaattttaaatatatatttatcctcttccatgttaagaaccctaagaaataactggacgagtgtggtatgatgtttgcatgtgatattcattacagtattattttaatagtagaaaattgttaaaaatctatatgtccattaataggaaattggttaaataaaatgaggcttccacaaactgaaaaaaaaaa

SEQ ID NO: 287107 - DNA, 3603 bp, Homo sapiens
aacctgactacctttatctatggatttatttatagtttgtcacacggtcgaatagctccttcttctcagtaatacaagcttttttggtttgaaatatggatcctcttcccagcataataatgtgattttttttattcattttatgttattatattcacatttttacttaaaggaaaatgctgctatttgtgatgaaattgctcgtcttgaggaaaaatttcttaaagcaaaagaagaaagaaggtacttgctaaagaagctcctccagcttcaggctctaactgaaggggaagtacaggctgcagctccttcccacagttccagtttgcccctgacttatggtgtggccagctctgtgggaactatacagggagctgggcctatttcagggcccagcactggggctgaggaaccatttgggaagaaaactaagaaggagaaaaaagaaaaaggcaaagagaacaacaaactggaagatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcagtttgaaattgttcctgaagatgacccccagaatgccattgtcagctcttctgcagatgcttgtcatgcagaactgctcaggactataagcactactatggggaaactaatgcctaacctgcttccagctggagctgacttttttggattttctcatccagccatccacaacctgatccagagctgtccaggagctcgaaaatgcatcaattaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtcaattctgtttactttcatcttgtaatcgggatgtaatcttttttgcttagctctgcctgaggtaaagtaaacttcagcctcttataaacaagagtgatagagagctgcaggctgctacaacaaataccatagacaggttggtttataaataacatgaatttatttctcacagttctggatgctgggaagtccaagttcaaggagcgcagattcaatgtctggtgagggcccacttcctagttcttagacagctgtcttcctgcagtgtcctcacgtggtagaagaggaaggcagctctccggggtcccttttataagatcactaagccggttcatgagaggtctgctctcatgacctaatcacctcccaaaggccccacctcccaataccatcacattaggggttaggatttaacatgaattttggggacatataaacattaagtctgtagtagcagcagctgactaacgagggagatagggagattctgacaaacttctactcttgattgtgatcctaattcaaggaatatcaagtcccagcccctgcaacccaggctgctgcttaattttcatgtcagtatcatcaaaatccaatgttctgcttaaactcaagatggaaagtccagtccaaggtacactgttcatctttttcttcacattttgcacatccttcaaggggatctttaacctctttaacctttgtattgcacctcagataatgtgctttttagctcagtacactgaaaccatatgataacacaaattcacatataattgggggttagtcccatactctataacagacttagtcctgtcttttcattagccatgtaataatataactccatgttccatgcaactggatttttggaccctgttaatagcattaaggtagaggtttactctatcacctaacacctcaacactacctgtgggatgccttagttacccagcagcaggttaccaagggctgtctggaaagggagggacaaaaggacccagaagtagaagaatggggatggagtggtgagaattgaatggttaatgcactgccattcataattgccaattgaggacaacacaaatgggattggtactttatagtaataaatctgaccagcagagggagggatcaggcagcagtgtttagagcacaccacactggccactgtaaactgagaagctaagttaactggtattttatgattttgagtatagtctttttataagttgtatacactttacaatgtaaaagaaacaaactttgtataatagcaaatcgggaaggggactgcttaaaatgttaatgcagtgtttttctttttttctctgcataaatggcttgagcatactggcatttacacagaaatgatatatgctgcttttatcatataacaaatattttcccactattacagcctgagtaatacccgtattaaaagagcctcattttagaaagacatttaaaatttttggaacataccacatgtagaaaggttgaactggtttttcagctataatgcatatacaactatagtgtgtacgtataccacatatacatatacttgtatgaagatatgtgtaaaatgtttttactatggatcatggatttaagaaacttgaaaagctgggcacggtggctcacgcctgtaatcccagcactttgggaggctgaggcgggtggatcaagaggtcaggagatcgagaccatcctggctaagtcggtctctaataaaaatacaaaaaattagccaggcgtggtggcacgcgcctgtagtcccagctactcgggaggctgaggcaggaagaatcgcttgaacccgggaggcagaggttgcagtgagccgagaccgcgccactgcactccagcctgggcaacagagcaaaactccaactcaaaaacaaaaacaaaaacaccttgaaaaacactgccttagtatacttaaactatcttttcatctatcagattgttaaggattttttttaaatttgacaacatccagtgtcaatgagggtgagggcaaaaaaaggactaccttggtgagaatgtaagttgtttaatcctttgggagggttaagctgtagatatctaaattttaaatatatatttatcctcttccatgttaagaaccctaagaaataactggacgagtgtggtatgatgtttgcatgtgatattcattacagtattattttaatagtagaaaattgttaaaaatctatatgtccattaataggaaattggttaaataaaatgaggcttccacaaactgaaaaaaaaaa

SEQ ID NO: 287108 - DNA, 1603 bp, Homo sapiens
ttcatgagaagccagacactgaggccagctcaaactcagggaaaggcagtgagactcacacctttgaagggaagggcaccaaggagccacattctacctgctttggccacgttgtctggcttctccagcctcagtctctttggccatgacaccataacgatgggaggggtgagttaatagacaccaaacagaactgctgtagcaactgccaaatgccttgcacagaggaggagtgtggggtgcccatgatattactctgcaagtgacattgccttctagggctttaatctcccagaaagccagagatggaatatctcagtgcttctgagcctttattttcagccctacccgcaacagcattctgcagcttgatctataatggggtgcaccacaccctctcagcctggtcagggatgggggccaaggactccctgtacctgtctcatctggagacgaaactcacctgggactaaccaaaaagaattagaagaaaaagcgaagtctcattacaaaaacacagaggattttagcccagtataactctagaagaaatggaatcctattaaggaaggaagtttggggcaaagcaccaggaaatccctcaaccggaagtgttgctagattgaggaagtgtcctaaaggaagtgggagacagctgtgggcactgtgtgcccagccccggccttcccagcagagtctgtgtgcatcgtgtcccaagtaaaaacaattcagttaccagaatggggtagttccttcacttgctaaaataaatgggtgtgtgggtgtgtgtgtgtgtgggtgtgtgtgtgtgtgtgtgtgtgtagtggctcttcatttgtttctccttcctaccactgttctcagccatttgaggagtggaaggtcgtggactggggaaagggccttccactctggctctctggttttccgtgttgttgggaacagtacgtcccaggctgtttgctttaaccagcgtgccttttatcactgcagaagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287109 - DNA, 1022 bp, Homo sapiens
ttcatgagaagccagacactgaggccagctcaaactcagggaaaggcagtgagactcacacctttgaagggaagggcaccaaggagccacattctacctgctttggccacgttgtctggcttctccagcctcagtctctttggccatgacaccataacgatgggaggggtgagttaatagacaccaaacagaactgctgtagcaactgccaaatgccttgcacagaggaggagtgtggggtgcccatgatattactctgcaagtgacattgccttctagggctttaatctcccagaaagccagagatggaatatctcagtgcttctgagcctttattttcagccctacccgcaacagcattctgcagcttgatctataatggggtgcaccacaccctctcagcctggtcagggatgggggccaaggactccctgtacctgtctcatctggagacgaaactcacctgggactaaccaaaaagaattagaagaaaaagcgaagtctcattacaaaaacacagaggattttagcccagtataactctagaagaaatggaatcctattaaggaaggaagtttggggcaaagcaccaggaaatccctcaaccggaagtgttgctagattgaggaagtgtcctaaaggaagtgggagacagctgtgggcactgtgtgcccagccccggccttcccagcagagtctgtgtgcatcgtgtcccaagtaaaaacaattcagttaccagaatggggtagttccttcacttgctaaaataaatgggtgtgtgggtgtgtgtgtgtgtgggtgtgtgtgtgtgtgtgtgtgtgtagtggctcttcatttgtttctccttcctaccactgttctcagccatttgaggagtggaaggtcgtggactggggaaagggccttccactctggctctctggttttccgtgttgttgggaacagtacgtcccaggctgtttgctttaaccagcgtgccttttatcactgcagattgttcccgctgggatcctctagatcac

SEQ ID NO: 287110 - DNA, 3272 bp, Homo sapiens
agcggggggtgggacggggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287111 - DNA, 3247 bp, Homo sapiens
gccgcctactactactaaattcgcggccgcgtcgacgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287112 - DNA, 3307 bp, Homo sapiens
agcggggggtgggacggggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaagaattaatagaaaatggcagcccaagaggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287113 - DNA, 3386 bp, Homo sapiens
  misc_feature (103)..(103): n is a, c, g, or t
agcggggggtgggacggggcgcgctgaggaggcggtgcgctcaggcggcgctcccggagatgccccgcggcagccgcgctcggggctctaaggtattcagtanaagcagatgaacagccagatgaagagatggatagagcaagacatggacattataaaggaattcaatagaagcacatgaacggccagatgaagagatggatagaagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287114 - DNA, 3108 bp, Homo sapiens
agcggggggtgggacggggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287115 - DNA, 3233 bp, Homo sapiens
agcggggggtgggacggggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctctcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287116 - DNA, 2741 bp, Homo sapiens
ggatatcgacgtcgtgatccagaagtccagagctgaggactgcctgtttgcagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287117 - DNA, 2895 bp, Homo sapiens
gccgcctactactactaaattcgcggccgcgtcgacgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287118 - DNA, 3337 bp, Homo sapiens
agcggggggtgggacggggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagatccagagaccaggaaccctggcagaaatcctccttccttcacttggtttccttctggctaagagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287119 - DNA, 2717 bp, Homo sapiens
agcggggggtgggacggggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctctcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287120 - DNA, 4682 bp, Homo sapiens
agcggggggtgggacggggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtgtgcttgcgtctccacagctttgatgcaggggcgactgatccgtgcccatagaatacctcttgtggcctctggatgcctccttgttgcttggacgctgccggcaccttcacggagcccatcacagacatggcccatgtaccagcctccagccttcactgaccctgtagcagccacctgggcagaaccagctccatggagatgctgtgctcactccagaattgcctgctggtggcaccccatactgctgcagactccacaaacaaaccaaaagctagaatattataaatgcgtatacttagatcagccagcccctttttccagggatcaaactaaaatcctgcctcagctatcttttttaatttttattgagtcataattcacatgccacataatttaccctgtgtggattgacttgaatctcacatttgagtgcttttttagcttagctcatggggttcaggagtgtgcacacacaatgaacgtgctgctggacacagtcccataactgcaccttcacctgcatgactcgaggggtagcaaaggagactgccattatgggcacaattcactttttcttcaaggcttcaataacctgaagtgtctctgtcggcaggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagcactttgcagttcactacttttgggaaaatgttctagggaactgtatcacaggtgaaactgttacccataaagtgtagctctctgaactggtgtgatcgtgtctctgctgaatggtggtggggatagctggctccaccacacacacctgttttaattaggctgggtaatgtgcacggagagcaaagatcacagactaaggagcagtcagtcggatatttgctttgctggcaaagatttaaaccaagaattaattatctttggacactataaagattttgttcccttccttatagcaatataatcatgacaggccatggttaactacatcagatacacgtagcagccgtgactaattaaatcttaaagcactgcaattactggcaagacagctggtcttaagcagttttgtgactgcccttttcatccactacatgactattccggcctttctggagcacttttgaaaatctacttgactctgtccacaagactgaggaaagtgaaagcaaagtcccgggaaagcgggagatgattcagcccggggttctgcccctcgcccctccagcagcctctacagttagggagctcttgaactgttctcagcaggggcccccaaaaagtcaacccttccccaggtctgcgttcttcgggagaacaccttctgctggaaagctgctagcttacctgagctcagccgtgctccacctagcttaggcaagttaaataaggccaggagagagcctttaatgcgttttaaaagcgacagaccctctctcctgagtagctcgggcctg

SEQ ID NO: 287121 - DNA, 1753 bp, Homo sapiens
acagctgtctgtgaggcagcaggccctcaaccagatgccaaacctgctggtgccttgatctgggacttcccagcctccagaactagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287122 - DNA, 1711 bp, Homo sapiens
agcggcttcaaatacagctgatttttagaggtcagatgaactgtgactgagtgtgacgggaaacgtggctctcccttcactgatgggtagctgacttgacctccccccatgctctctggcagtcttgtgggagctgctgggtgagctgctgactgctgcagagcctgccagactagggacctggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287123 - DNA, 1630 bp, Homo sapiens
cactagagatgccgcggccccagctgcacacaaaaggaccctggtgtgggggacccttacaaaagaggacggaaacaacatagttttaaaccaataaaccttgacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287124 - DNA, 2897 bp, Homo sapiens
agcggggggtgggacggggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtttcctcacatattatcctttattctaaaaaacttcg

SEQ ID NO: 287125 - DNA, 2820 bp, Homo sapiens
agcggggggtgggacggggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacaggtaaggggacaggagctgtcctgaaagccctagaactgaaagggcacagaagcaacccagccccagaacctgggccttgctacctcaggtgactccctcgagagctcaaggggcaacctctgcctctgctgagcagcaagggaagaggcctctggggcccagtgggttttccttactgagatttctgctgtttcttgcagctgctcctgttatgagatagatgtgctgggttttgtccccacctcctttattatcagccaggagaattaaaaaaacaggacaaacatgaataagtgaaaaaaacttggtgactgtatagcctagct

SEQ ID NO: 287126 - DNA, 1958 bp, Homo sapiens
  misc_feature (103)..(103): n is a, c, g, or t
agcggggggtgggacggggcgcgctgaggaggcggtgcgctcaggcggcgctcccggagatgccccgcggcagccgcgctcggggctctaaggtattcagtanaagcagatgaacagccagatgaagagatggatagagcaagacatggacattataaaggaattcaatagaagcacatgaacggccagatgaagagatggatagaagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaaggtaagaatgaagtatttcaaaacttttattcactttataacatttgctaatcatagttgtcatttttttttttgtttttttttttcctgtccttcctcgagaacaaccacttttgactcttaggggattcttttgttctttactcacttatctctaaataacatgcttgtgctgtacttctcaacatggataaatattgatctcacttctctttcacttcccaccctcactgcacaccgaatgttttttatcctgctattcttccagtgcagatatatcaaagtgctggaattgcacatgtcagccaccatacctgggcaaaaagatacaaatttaaatcagctgtcttccacgagtcctctcccagtggagtcacacagtatatgcttaattcttccagcaaaatgtttagacaacatgtgtgaagtgttatgtaccagggaactcattagagactcagtgcccagggtttgtattaggggctagtaacataggcaccctctccctagaaggttcagcagtggactaggaggatacacaggacttagcatatagtcgtactcgtggccatcgtttattacactgaaaggatagaaatctatttttatttatttatttagagacagggtcttgctgtgtcacccaggctagaacgcaatggtgcgatcgtagctcactgtagccttgatctcctgggctcaagtgatcctctcacctcagcctccagagtagctggtcctacaggcatgtgccaccacgtctggctaattgttgtattttttgtatgttaactcttttctacacagacatgatttaccttttgtggactagctttaccccaaattgcattgttaaagttttgaatttataattaatgacagcgtggactacttagtattttaactgtatttgagaccacaagtagtttcttcaatattttctcaagcccttgagacacttaattctccctcttgacttcctcttcatcttagaaactgcaatttcctttgtaggaacaacttcctgctgggtactgccctctttggccacttctgtcttgggtgcctatgtttttatctaaagccataagtgcattgcaacactagccatttcatcatcatgtgaattgagaaagtctagcaggaagtcacaagttgattgtccccaatacaagcccaaatgtttcttggttgctgtgtcataataggcagttggtgttctgaatggcagttatgaagaggatactttgtagaaaggact

SEQ ID NO: 287127 - DNA, 1045 bp, Homo sapiens
gccgcctactactactaaattcgcggccgcgtcgacgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacatacgcccaggtaagcatgcgtacctgggcgtatgcccctattcctaacactcacaacaaaactaactaatactaacatctcagacgctcaggaaatagaaaccgtctgaactatcctgcccggcatcatcctaagtctcatacgcctccc

SEQ ID NO: 287128 - DNA, 825 bp, Homo sapiens
  misc_feature (346)..(346): n is a, c, g, or t
  misc_feature (348)..(348): n is a, c, g, or t
  misc_feature (351)..(351): n is a, c, g, or t
  misc_feature (354)..(354): n is a, c, g, or t
ctaaacttaatacattataattcattaaacagaggtggactagcagaaagactaaatggactgcagaatcgagagagatctgctatttctttgtggagacatcaatgtatttcttaccaaaagacactttcagggtaaggcttgtgcaggaatctgagacaatgtgtaaaaaaatattttagttaaaagaattcttacattaaaatatatgaagttaattgttaatattttcatgactttttaaaaattttttccaacattctaattttaacatataaaaactatatatagtaaatatatttaacttgatgagtttaaaaataagcatactcttatgaaaacatcnanccnacnaatctgtgctataaatctacccttgacctccaaaaattttgttctattcttatcattaagagcactctaccctcttagcaaaatttattttgttttatttcattatttagagacagggtctcaccgttgcccaggctggagtgtagtgacataatcatgtagcctcaaactcttgggctcaagcaaattctctcacttcagcctcccgactggctaagaccacaggctttttccaccgtgcccagctcctcttagcaaaattttaagaatacaatacagtatgttaactataggcatgattctgtactgcagatctctaggactggtttagcttatataatcaaaacgttgtaccctttgacaaatacctctctattggcagccaccattgcagtctctgcttctgtagccagagcactattagtcaagaaaaagagataaaagatatccaagttggaaagcaagaggtaa

SEQ ID NO: 287129 - DNA, 370 bp, Homo sapiens
tcagttaggtggtaatatgcaggcaagttttaaaacgtacttcttattgttataatttttctttgtacaataagtggaaattataaaaatcttaggaacatgtatataaactcccaagtaaggcaaaaatcacgaggcccctcatgttgtcctctgcacgtggaggagcagaggagtcagagagggcagagccgcctctgaggtgggctttccttctcttgggcctaggcactgtggttggcgtggacgagagcactgctttctcatggcctgtgtgtgacatgtgtggcaacgggagattggaacagaggccggaagacaggtaaggggacaggagctgtcctgaaagccctagaactgaaagggcaca

SEQ ID NO: 287130 - DNA, 3888 bp, Homo sapiens
agcggggggtgggacggggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtgtgcttgcgtctccacagctttgatgcaggggcgactgatccgtgcccatagaatacctcttgtggcctctggatgcctccttgttgcttggacgctgccggcaccttcacggagcccatcacagacatggcccatgtaccagcctccagccttcactgaccctgtagcagccacctgggcagaaccagctccatggagatgctgtgctcactccagaattgcctgctggtggcaccccatactgctgcagactccacaaacaaaccaaaagctagaatattataaatgcgtatacttagatcagccagcccctttttccagggatcaaactaaaatcctgcctcagctatcttttttaatttttattgagtcataattcacatgccacataatttaccctgtgtggattgacttgaatctcacatttgagtgcttttttagcttagctcatggggttcaggagtgtgcacacacaatgaacgtgctgctggacacagtcccataactgcaccttcacctgcatgactcgaggggtagcaaaggagactgccattatgggcacaattcactttttcttcaaggcttcaataacctgaagtgtctctgtcggcaggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287131 - DNA, 3103 bp, Homo sapiens
agcggggggtgggacggggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287132 - DNA, 3502 bp, Homo sapiens
  misc_feature (103)..(103): n is a, c, g, or t
agcggggggtgggacggggcgcgctgaggaggcggtgcgctcaggcggcgctcccggagatgccccgcggcagccgcgctcggggctctaaggtattcagtanaagcagatgaacagccagatgaagagatggatagagcaagacatggacattataaaggaattcaatagaagcacatgaacggccagatgaagagatggatagaagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaaggttttggcaattatgattgaaggtgctataaacatacatttggaagtttccgtgtggagataaactttcaactcctttgagtagataccaagcagagcaactattggattgtattgccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287133 - DNA, 3322 bp, Homo sapiens
agcggggggtgggacggggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagctcgtccctctgttcggggtccctgacttcctgcaacacttaagtttcttaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287134 - DNA, 3021 bp, Homo sapiens
agcggggggtgggacggggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287135 - DNA, 3327 bp, Homo sapiens
agcggggggtgggacggggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaaggtaggagccaggccagagcacgcacgcactcctagctcactccaacatagcgaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287136 - DNA, 4736 bp, Homo sapiens
agcggggggtgggacggggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtgtgcttgcgtctccacagctttgatgcaggggcgactgatccgtgcccatagaatacctcttgtggcctctggatgcctccttgttgcttggacgctgccggcaccttcacggagcccatcacagacatggcccatgtaccagcctccagccttcactgaccctgtagcagccacctgggcagaaccagctccatggagatgctgtgctcactccagaattgcctgctggtggcaccccatactgctgcagactccacaaacaaaccaaaagctagaatattataaatgcgtatacttagatcagccagcccctttttccagggatcaaactaaaatcctgcctcagctatcttttttaatttttattgagtcataattcacatgccacataatttaccctgtgtggattgacttgaatctcacatttgagtgcttttttagcttagctcatggggttcaggagtgtgcacacacaatgaacgtgctgctggacacagtcccataactgcaccttcacctgcatgactcgaggggtagcaaaggagactgccattatgggcacaattcactttttcttcaaggcttcaataacctgaagtgtctctgtcggcaggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagcactttgcagttcactacttttgggaaaatgttctagggaactgtatcacaggtgaaactgttacccataaagtgtagctctctgaactggtgtgatcgtgtctctgctgaatggtggtggggatagctggctccaccacacacacctgttttaattaggctgggtaatgtgcacggagagcaaagatcacagactaaggagcagtcagtcggatatttgctttgctggcaaagatttaaaccaagaattaattatctttggacactataaagattttgttcccttccttatagcaatataatcatgacaggccatggttaactacatcagatacacgtagcagccgtgaccaagacatggtgccctaataccaagtgttcttgggttaaaggcaggcggctttttaattaaatcttaaagcactgcaattactggcaagacagctggtcttaagcagttttgtgactgcccttttcatccactacatgactattccggcctttctggagcacttttgaaaatctacttgactctgtccacaagactgaggaaagtgaaagcaaagtcccgggaaagcgggagatgattcagcccggggttctgcccctcgcccctccagcagcctctacagttagggagctcttgaactgttctcagcaggggcccccaaaaagtcaacccttccccaggtctgcgttcttcgggagaacaccttctgctggaaagctgctagcttacctgagctcagccgtgctccacctagcttaggcaagttaaataaggccaggagagagcctttaatgcgttttaaaagcgacagaccctctctcctgagtagctcgggcctg

SEQ ID NO: 287137 - DNA, 1874 bp, Homo sapiens
tggctgtgttgctgcaagtgggacaccaggttttatcctgctgggatatgcgtgtctaaacgtgtactgtcgcagagaatgcctcttattgttgttcttatcgtaatgttatcctgcagcttttctcagtatcgagcatccacacaaagcaaatatttctttcatgggaaacggtaaaaatgggaaaaggacactctgtttctagagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287138 - DNA, 1880 bp, Homo sapiens
agtgatgaccgtgcgggacttcacacaggtgtttgacagctacgcccagttcgaggagagcatgatcgctgcaaagatggagaccgcctcggagctggggcgcgaggaggaggatgatgtggacctggaactgcgcctggcccgctgaagatgatgttcatcatcttcagcggggggccagctcaggacacacagccccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287139 - DNA, 1495 bp, Homo sapiens
gagttacgaagttcgagcgtcggtactccaggccgcgggtctgaactgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagc

SEQ ID NO: 287140 - DNA, 2902 bp, Homo sapiens
agcggggggtgggacggggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaaggacagcggggattttcagtttgattgacaccctgtggcccccagcgatacctctgaaaacacctggccgcgaccagccctgtgaagagataaaaactcatctgcctcctccagccttgtgttacatcctcacagctcatccaaatctgggacaaattgatataattgacgaagaccccatttataagctttaccagcctccagttacccgctgcttaagagacattctccagatgaatgatcttggtacccgttgcagtttctatgccacggtgatttaccaaaaaccacagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatggggtaagtgcagggggcccagcccagggggccgcacactcagtagcctgcatgagcaactcatccccagaggaagcccccactcccaaatgtgttctattacaacccatcccactaggaagtggtgtagacactcgagagtgaaatgcagatatgtctgccattcagactgataggttcctttcctctgtggaaatgaggttattttagatcattgttgaggtagatgcaggaatctgtcc

SEQ ID NO: 287141 - DNA, 1791 bp, Homo sapiens
agcggggggtgggacggggcgcgctgaggaggcggtgcgctcaggcggcgctcccggagatgccccgcggcagccgcgctcggggctctaagagaaaaaggagttggaatacagaatgcccatcctttccaggagaaagaccactgcaggtcagaagagcaggtctcaggacagcaggggcagctgcctctctctctgaagcatggctcaggtgtggagaagggtttcagaacacttctgggaatccgtcattaacagctgaagagaagacgattacagaaaagcaccttgaattatgccctagacccaagcaagaaaccaccacatctaaaagcaccagtgggcttacagacataacatggagctccagtggaagtgatttgtcggatgaagataagacactttctcagttacagagagatgaattacagtttatcgactgggagattgacagtgacagggcagaggctagtgactgtgatgaatttgaagatgacgagggtgctgtggaaatctcagactgtgcttcttgtgcaagtaatcagtctttgacaagtgatgagaagctgtcggagcttcccaagccaagttctatagaaattttagagtattcatcagatagtgaaaaagaagatgatttggaaaatgtcctactcattgattcagaatcccctcacaaataccacgtgcagtttgcatcggatgcaagacagattatggagagactgatagatccaaggacaaaatcaacagagaccattttgcatacacctcagaaacccacagctaagtttcccaggactccagaaaattcagcaaagaagaagcttttaagaggtggactagcagaaagactaaatggactgcagaatcgagagagatctgctatttctttgtggagacatcaatgtatttcttaccaaaagacactttcaggtagaaaatctggtgtattaactgtgaaaattttagagctgcatgaggaatgtgccatgcaagttgccatgtgtgagcagttattggggtcaccagccaccagctcctcccaaagtgtggctcccaggcctggagctggcctgaaagttctcttcaccaaggagactgcaggctacctcaggggccgtccccaggacactgtccggatcttccctccctggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggttgtgtgtagtggtgtagccactacagggacagcctggacccatgggcacaaagaagcaaaacagcgcatcccaaccagcactcccctgagggattctctcctggatgtggtggaaagccagggagctgcctcgtggccaggagctggagtccgagtggtggtgcaaagagtgtattctcttcccagcagagacagcaccaggggtcagcagggggccagctcaggacacacagacccagctggaactcgagcctgccttctggtacaagatgcctgtggaatgttcggtgaagtgcacttggagttcaccatgtcgaaggcaagacagttggaagggaagtcttgcagcctggtgggaatgaaggttctacagaaagtcaccagaggaagacagcggggattttcagttgatcgagctacgggatcctctagaccag

SEQ ID NO: 287142 - DNA, 1262 bp, Homo sapiens
ctgactccgatttaggaatatcctaccacttctccatcaacaaatctcccatcactgccgtcccacggcctcgctcgcgcccacagacccactcacaattccttgatcagcaccatcttcccggaaccccctcacagctgccgccgataccaccgccgccgccgccgctaccgcctctcacagcgcctgcgcggccccgcctccctgcccccccgagccaccatcgcgcctgcgtgcttacacccttccgccgcgaccagtcgcgtcagcgcgcgagggggcctagctccgcccagtttcgtgccccaccccgggcacacgaggcctccactgcggttgcgcagcctgccgaagagcgtgcggcttctactgcggctgcgcaagctcgacgcgcactcttgtctgcttacgagggctcctcccttcagctttggtccctcggggcgtctgggcagcctacgctttccgactggaatcagccattttaccaagaaagttgggtttcttttactggcaaatagtacttcaagagcacagtcttatgtaagaagtacagtctatataaagactgtccaggacaaaaactggccactccattcagcattgacagcagtatttaaagctggtgcatggtgaggtgaagtttctcaagggcaaagacaatgccttcatgcatgttcagtgtctgcccccgtgggcttttggaaatgatcgctgacaatgggggatctgcagtgacttctctggcctctgccaaagcccagggggtgctgctccctaattctaaggattctaatgagactcagagcaggtgtaacacagggcatggagcttcctgagcaagaggctggctaacaaactgtggacgtggtacttagacacattaagagacattacagggacacctgcaagtatgtctccctggggagaagccaagtgcagatgctatggccacagatgatatggtttggctctgtgtccccactcaaatctcatctcaagttgtaatccctggatgtcgagggagggacctggtgggaggtgattggattggttcgcatgatagtgagggagttctcacgagatctggttgtttgataagtgtctggcatttctcctgtgctgtctctcctgccaccttgtgaagaaggtgcctgcttctccttcgccttccgccatgattgtaagtttcctgaggcctccctagcaatgcagaactgtgagtcaattaaacttcctttctttataaattaaaaaaaatc

SEQ ID NO: 287143 - DNA, 1107 bp, Homo sapiens
gcttgcttcccggttttcaggattacttcctcctgaccaacttcacagagatcaaaacctagaggaacaaagaatataagcatctgcttccttcgggaagattccagatcttgaacatgagcgctatagggctccttgtgcaacttcatggaatgcctgcaaggcccttcagcaagcatttgggcctggggcttccccatgtctgcacagaggttggtcatgtggcagaggggtcgggctgccccacccagaacatccactctacgcagcccccatttggcgtgtgtgtggctctcactgcctggctctcctctgtcccttcacggaaagcactatggaccagaactcagtaaggctcactcacatgttttcttttccatttttttttcacagaagtacagtctatataaagactgtccaggacaaaaactggccactccattcagcattgacagcagtatttaaagctggtgcatggtgaggtgaagtttctcaagggcaaagacaatgccttcatgcatgttcagtgtctgcccccgtgggcttttggaaatgatcgctgacaatgggggatctgcagtgacttctctggcctctgccaaagcccagggggtgctgctccctaattctaaggattctaatgagactcagagcaggtgtaacacagggcatggagcttcctgagcaagaggctggctaacaaactgtggacgtggtacttagacacattaagagacattacagggacacctgcaagtatgtctccctggggagaagccaagtgcagatgctatggccacagatgatatggtttggctctgtgtccccactcaaatctcatctcaagttgtaatccctggatgtcgagggagggacctggtgggaggtgattggattggttcgcatgatagtgagggagttctcacgagatctggttgtttgataagtgtctggcatttctcctgtgctgtctctcctgccaccttgtgaagaaggtgcctgcttctccttcgccttccgccatgattgtaagtttcctgaggcctccctagcaatgcagaactgtgagtcaattaaacttcctttctttataaattaaaaaaaatc

SEQ ID NO: 287144 - DNA, 1423 bp, Homo sapiens
ctgactccgatttaggaatatcctaccacttctccatcaacaaatctcccatcactgccgtcccacggcctcgctcgcgcccacagacccactcacaattccttgatcagcaccatcttcccggaaccccctcacagctgccgccgataccaccgccgccgccgccgctaccgcctctcacagcgcctgcgcggccccgcctccctgcccccccgagccaccatcgcgcctgcgtgcttacacccttccgccgcgaccagtcgcgtcagcgcgcgagggggcctagctccgcccagtttcgtgccccaccccgggcacacgaggcctccactgcggttgcgcagcctgccgaagagcgtgcggcttctactgcggctgcgcaagctcgacgcgcactcttgtctgcttacgagggctcctcccttcagctttggtccctcggggcgtctgggcagcctacgctttccggataaaaatggcagaatgaaagaattatgagtggaactagagaataggaaagacatgaaccaacgcccaaaatgagaaagaaggacatataaagaaaaagacaaatacaagtgaaaaaaatagactaatggattaacgtccctgtcgtgtgacattttctgactggaatcagccattttaccaagaaagttgggtttcttttactggcaaatagtacttcaagagcacagtcttatgtaagaagtacagtctatataaagactgtccaggacaaaaactggccactccattcagcattgacagcagtatttaaagctggtgcatggtgaggtgaagtttctcaagggcaaagacaatgccttcatgcatgttcagtgtctgcccccgtgggcttttggaaatgatcgctgacaatgggggatctgcagtgacttctctggcctctgccaaagcccagggggtgctgctccctaattctaaggattctaatgagactcagagcaggtgtaacacagggcatggagcttcctgagcaagaggctggctaacaaactgtggacgtggtacttagacacattaagagacattacagggacacctgcaagtatgtctccctggggagaagccaagtgcagatgctatggccacagatgatatggtttggctctgtgtccccactcaaatctcatctcaagttgtaatccctggatgtcgagggagggacctggtgggaggtgattggattggttcgcatgatagtgagggagttctcacgagatctggttgtttgataagtgtctggcatttctcctgtgctgtctctcctgccaccttgtgaagaaggtgcctgcttctccttcgccttccgccatgattgtaagtttcctgaggcctccctagcaatgcagaactgtgagtcaattaaacttcctttctttataaattaaaaaaaatc

SEQ ID NO: 287145 - DNA, 1182 bp, Homo sapiens
ctgactccgatttaggaatatcctaccacttctccatcaacaaatctcccatcactgccgtcccacggcctcgctcgcgcccacagacccactcacaattccttgatcagcaccatcttcccggaaccccctcacagctgccgccgataccaccgccgccgccgccgctaccgcctctcacagcgcctgcgcggccccgcctccctgcccccccgagccaccatcgcgcctgcgtgcttacacccttccgccgcgaccagtcgcgtcagcgcgcgagggggcctagctccgcccagtttcgtgccccaccccgggcacacgaggcctccactgcggttgcgcagcctgccgaagagcgtgcggcttctactgcggctgcgcaagctcgacgcgcactcttgtctgcttacgagggctcctcccttcagctttggtccctcggggcgtctgggcagcctacgctttccgaagtacagtctatataaagactgtccaggacaaaaactggccactccattcagcattgacagcagtatttaaagctggtgcatggtgaggtgaagtttctcaagggcaaagacaatgccttcatgcatgttcagtgtctgcccccgtgggcttttggaaatgatcgctgacaatgggggatctgcagtgacttctctggcctctgccaaagcccagggggtgctgctccctaattctaaggattctaatgagactcagagcaggtgtaacacagggcatggagcttcctgagcaagaggctggctaacaaactgtggacgtggtacttagacacattaagagacattacagggacacctgcaagtatgtctccctggggagaagccaagtgcagatgctatggccacagatgatatggtttggctctgtgtccccactcaaatctcatctcaagttgtaatccctggatgtcgagggagggacctggtgggaggtgattggattggttcgcatgatagtgagggagttctcacgagatctggttgtttgataagtgtctggcatttctcctgtgctgtctctcctgccaccttgtgaagaaggtgcctgcttctccttcgccttccgccatgattgtaagtttcctgaggcctccctagcaatgcagaactgtgagtcaattaaacttcctttctttataaattaaaaaaaatc

SEQ ID NO: 287146 - DNA, 1244 bp, Homo sapiens
ctgactccgatttaggaatatcctaccacttctccatcaacaaatctcccatcactgccgtcccacggcctcgctcgcgcccacagacccactcacaattccttgatcagcaccatcttcccggaaccccctcacagctgccgccgataccaccgccgccgccgccgctaccgcctctcacagcgcctgcgcggccccgcctccctgcccccccgagccaccatcgcgcctgcgtgcttacacccttccgccgcgaccagtcgcgtcagcgcgcgagggggcctagctccgcccagtttcgtgccccaccccgggcacacgaggcctccactgcggttgcgcagcctgccgaagagcgtgcggcttctactgcggctgcgcaagctcgacgcgcactcttgtctgcttacgagggctcctcccttcagctttggtccctcggggcgtctgggcagcctacgctttccggataaaaatggcagaatgaaagaattatgagtggaactagagaataggaaagacatgaaccaacgcccaaaatgagaaagaaggacatataaagaaaaagacaaatacaagtgaaaaaaatagactaatggattaacgtccctgtcgtgtgacattttctgactatggaaatgatattagacaaaaagcaacttcaagtggttttcttatttgagttcaaaatgggtcataacgcagcagagataacttgaaacatgaacagcgcatttggcccaggaactactaacgaacatacagggcagctgtgattcaagaagttttgcaaagcagactagagccttgaatatgaggaacacagtggccagccattggatgcttcacttcttgaagcatcttgacagctttttgcaggtgaaatgcttccacaccagcaggatgcagaaaaatgctttccaagagtttgttgaatccagaagcatggatgtttatgctgcaggaataaacaaatttatttctcgttggcaaaaaagtgttgattgtaatggttcctattttgattaataaagatgtgtttgagcctagttataatgatttaaaattaatggtccaaaaatgcaattacttttgcaccaccaccaacacacacacacacctacacattctggatttgaattccatgttgattatatgcacttggaatatttcttttccatctgtggattgttctgtcacttattttctttaataaatgggtttctgaacctctgttgtattga

SEQ ID NO: 287147 - DNA, 1121 bp, Homo sapiens
ctgactccgatttaggaatatcctaccacttctccatcaacaaatctcccatcactgccgtcccacggcctcgctcgcgcccacagacccactcacaattccttgatcagcaccatcttcccggaaccccctcacagctgccgccgataccaccgccgccgccgccgctaccgcctctcacagcgcctgcgcggccccgcctccctgcccccccgagccaccatcgcgcctgcgtgcttacacccttccgccgcgaccagtcgcgtcagcgcgcgagggggcctagctccgcccagtttcgtgccccaccccgggcacacgaggcctccactgcggttgcgcagcctgccgaagagcgtgcggcttctactgcggctgcgcaagctcgacgcgcactcttgtctgcttacgagggctcctcccttcagctttggtccctcggggcgtctgggcagcctacgctttccggataaaaatggcagaatgaaagaattatgagtggaactagagaataggaaagacatgaaccaacgcccaaaatgagaaagaaggacatataaagaaaaagacaaatacaagtgaaaaaaatagactaatggattaacgtccctgtcgtgtgacattttctggtatgacagctgaagatgttgaaccgtatggtgcagttttgcaaatagtgtatgaagtgggttgtaagttttaccagtaattgtctatagatacaaaaaggagccaacctctttttttttcttttagtgtgatgttccttgttctatcttcgaactctcaaaggtagcctttacacagatgttcaaactaattctaccagtgtcatatgtctaccaatctcattacttcccttgtatgtacttctagagcaaagagctcattacagtaagaatgatggtaaattttactgaggcaaacaaagatttctgaacgcgagcagtgtgtgtgaaatgcttatgcactagctgatagcataactctggtcaaagaaatttggtcacttaaatattataattgaatttagcccctaaagtagctgttcttaacctggaatctgaagaacagcctgttggtggggctcccagggaatttgtgaaccactgaaattatat

SEQ ID NO: 287148 - DNA, 650 bp, Homo sapiens
aacaaatctgaaataccgatgtcaatttcacttactgctcttattgctcagaatgttctatctttggccagttgaatcccttcaaattgtctcctgaatcctgctgatgtgttcctggtaagtagtctttgacagcttcattggtataacaagatctagcacaaaagcttatctcatatattttctgccgttccagactggaatcagccattttaccaagaaagttgggtttcttttactggcaaatagtacttcaagagcacagtcttatgtaaggtaagtcatggcttctggatttgtaatcgttttttggcctttttagttgctagggcgaaaaaattttgtacacttaaatatatagataatgcatagggatatcgattatataaatatgacaggaacacttaatgtattatgtgcatacagttgacccttgagcaacatggatttgaactgcacagatccacttatacatggattttttttcaataaatatattggaaaattttttggagattcacaatgatttaaaaaaaaaaaacacttggccgggcgtggtggctcacgcctgtaatcccagcactctggggggccgaggcaggtggatcacgaggtcaggagatcgagaccatcctggctaacatggtgaa

SEQ ID NO: 287149 - DNA, 180 bp, Homo sapiens
taaccggtttagatgtatttattgacggaaagattaggttgctggaaaacatgaaatctatataataaaataatcctacattacatctatttacaggataaaaatggcagaatgaaagaattatgagtggaactagagaataggaaagacatgaaccaacgcccaaaatgagaaagaagg

SEQ ID NO: 287150 - DNA, 1038 bp, Homo sapiens
agggggcaagcgccgcctccgccgcgtgtccggggtcagcccgagcccgtgcgggccctttaagggccgggggcgtgtagcgggcccgccccctccccgcggcgcccgcagtccgttaagtgcgagccccggcgcaggggccggatctggccgggggccggcggcggtgtgggagcggcgcgtcatgtacaccatcaccaaggggcccagcaagctggtcgcgcagcgccgcacaggtcccacgcagcagcaggtggagggccggctcggcgagctcctgaaatgccggcagcccgcgccgccgacctcgcagcccccgcgggcgcagccctttgcgcagccgccgggaccctggcccctgtcgagtccagggccaaggcttgtgttcaatcgtgtgaatggccggcgggccccctccacgtccccatccttcgaggggacccaggagacctacacagtggcccacgaggagaatgtccgctttgtgtccgaagcctggcagcaggtgcaacagcagctggatggtggcccagccggtgagggcgggccaaggcctgtgcagtacgtggagaggacccccaatccccggctgcagaactttgtgcccattgacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtccaggataagggggacgtccaaaaaaaaactccgttttgtggagagaaagcggaattcaccttaaaggaagcccggtaacggagaaga

SEQ ID NO: 287151 - DNA, 1728 bp, Homo sapiens
gcgggagccatctcctttggcatcgccccttgtctcgggccggtggggagtgggcgagggttatagtcactctcccgactcagggactgcccatcccggcacccagtcctcatcccatgggacgtgggggcagccagggagagggcaaaggcccccgttcccgtccaggtccatccgtccatggagggaaacatcgtggagatggaggtgcttctgtggggcgagaatgtggcctagaactacacccagagtgggggggttggggcagagagacatggtcatggactgggtcgtggctcaggtcagaatctgggctgctgatgggatgcaggtggcagcatgggcacctgcaagaccctcggggaggggtactgagtggggcccgaccaaaggtttgggacactctaagactgaggcccccaccctacagtcactcacttccctcaggacacagggctgcaggtgtgagctgagctgccgatggcttggggactgcaagagaggcctgggccaccggctgctgtgggtggctgctctctctggttcaggaagtgcctaggctggccaagtctggggaaagtgggctggcccggggctgctcctgagttctgccaggcagcaccgcacctgggatgggcaccaaccatgtccgtctcctcccttcctgcagtccagggccaaggcttgtgttcaatcgtgtgaatggccggcgggccccctccacgtccccatccttcgaggggacccaggagacctacacagtggcccacgaggagaatgtccgctttgtgtccgaaggtagcgagcggggccagagggtgcggcataggctgctgggtcgcaaaaccatggacccgggatggccccacttcaagctgacccacagccgctgcatggctgtgcttttccttggcactctgcccttgtgtcctgtgaccagccctgtgtggggctggagtccagggtgaccatcaggccctgggtgggcgatggggtgcctgggacctggctcagcccgactgccctcctcccacagcctggcagcaggtgcaacagcagctggatggtggcccagccggtgagggcgggccaaggcctgtgcagtacgtggagaggacccccaatccccggctgcagagtgagccccccaaccctgtccccccaggagagaccccccagcccctctgatcctgacccaggccctgccaggttcccaccccaggggatgagggaggggactcttgtgcagaaaccccttcttcccagcgcctgccgcactcggagtccgggtgagcggcttgtggttagctccaggggagacttgccggctggcctgggaggcagcatcactgcccagccttctctgcccacagactttgtgcccattgacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtc

SEQ ID NO: 287152 - DNA, 693 bp, Homo sapiens
agggggcaagcgccgcctccgccgcgtgtccggggtcagcccgagcccgtgcgggccctttaagggccgggggcgtgtagcgggcccgccccctccccgcggcgcccgcagtccgttaagtgcgagccccggcgcaggggccggatctggccgggggccggcggcggtgtgggagcggcgcgtcatgtacaccatcaccaaggggcccagcaagctggtcgcgcagcgccgcacagcctggcagcaggtgcaacagcagctggatggtggcccagccggtgagggcgggccaaggcctgtgcagtacgtggagaggacccccaatccccggctgcagaactttgtgcccattgacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtc

SEQ ID NO: 287153 - DNA, 916 bp, Homo sapiens
agggggcaagcgccgcctccgccgcgtgtccggggtcagcccgagcccgtgcgggccctttaagggccgggggcgtgtagcgggcccgccccctccccgcggcgcccgcagtccgttaagtgcgagccccggcgcaggggccggatctggccgggggccggcggcggtgtgggagcggcgcgtcatgtacaccatcaccaaggggcccagcaagctggtcgcgcagcgccgcacaggtcccacgcagcagcaggtggagggccggctcggcgagctcctgaaatgccggcagcccgcgccgccgacctcgcagcccccgcgggcgcagccctttgcgcagccgccgggaccctggcccctgtcgagtccagggccaaggcttgtgttcaatcgtgtgaatggccggcgggccccctccacgtccccatccttcgaggggacccaggagacctacacagtggcccacgaggagaatgtccgctttgtgtccgaagcctggcagcaggtgcaacagcagctggatggtggcccagccggtgagggcgggccaaggcctgtgcaactttgtgcccattgacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtc

SEQ ID NO: 287154 - DNA, 1304 bp, Homo sapiens
agggggcaagcgccgcctccgccgcgtgtccggggtcagcccgagcccgtgcgggccctttaagggccgggggcgtgtagcgggcccgccccctccccgcggcgcccgcagtccgttaagtgcgagccccggcgcaggggccggatctggccgggggccggcggcggtgtgggagcggcgcgtcatgtacaccatcaccaaggggcccagcaagctggtcgcgcagcgccgcacaggtcccacgcagcagcaggtggagggccggctcggcgagctcctgaaatgccggcagcccgcgccgccgacctcgcagcccccgcgggcgcagccctttgcgcagccgccgggaccctggcccctgtcgagtccagggccaaggcttgtgttcaatcgtgtgaatggccggcgggccccctccacgtccccatccttcgaggggacccaggagacctacacagtggcccacgaggagaatgtccgctttgtgtccgaagcctggcagcaggtgcaacagcagctggatggtggcccagccggtgagggcgggccaaggcctgtgcagtacgtggagaggacccccaatccccggctgcagaactttgtgcccattgacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtcaaaaagatagaaagaataacagatagaaatgaataccacatgagagggggcggcgcgcgtctctgagaagttattccctctgaggggggcgccccagatttgtacagcggtcacccatggtttccttgtgtgcaccaagggtgggccccatagatgggtgcgagagggtgcgcttgtaattcaccgcttggggaactcgtgggacaccgctggtttttacaacgcatgggctcgtggagcacggggcgaactgcgggtcccactctttgggggaaaccgtgtccggaaagggggcaaccccgtaaaatccaggggaggggggcagacacaacctaggtgggcacgagctccct

SEQ ID NO: 287155 - DNA, 1003 bp, Homo sapiens
agggggcaagcgccgcctccgccgcgtgtccggggtcagcccgagcccgtgcgggccctttaagggccgggggcgtgtagcgggcccgccccctccccgcggcgcccgcagtccgttaagtgcgagccccggcgcaggggccggatctggccgggggccggcggcggtgtgggagcggcgcgtcatgtacaccatcaccaaggggcccagcaagctggtcgcgcagcgccgcacaggtcccacgcagcagcaggtggagggccggctcggcgagctcctgaaatgccggcagcccgcgccgccgacctcgcagcccccgcgggcgcagccctttgcgcagccgccgggaccctggcccctgtcgagtccagggccaaggcttgtgttcaatcgtgtgaatggccggcgggccccctccacgtccccatccttcgaggggacccaggagacctacacagtggcccacgaggagaatgtccgctttgtgtccgaagcctggcagcaggtgcaacagcagctggatggtggcccagccggtgagggcgggccaaggcctgtgcagtacgtggagaggacccccaatccccggctgcagaactttgtgcccattgacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtcaaaaaaaaaaaaaaacaaaaaaaaaaaaaacaaaaaaacaaaaaaagggggg

SEQ ID NO: 287156 - DNA, 1311 bp, Homo sapiens
agggggcaagcgccgcctccgccgcgtgtccggggtcagcccgagcccgtgcgggccctttaagggccgggggcgtgtagcgggcccgccccctccccgcggcgcccgcagtccgttaagtgcgagccccggcgcaggggccggatctggccgggggccggcggcggtgtgggagcggcgcgtcatgtacaccatcaccaaggggcccagcaagctggtcgcgcagcgccgcacagtgcccctctcagctgaggaggaaccgagagcggcgctggggcacctgagcccaggaaggcaacaggccggccgggaccgcgagtgcctggcggagcaggcgcagcccaggactcccggctcccacctccggctgtagtccagggccaaggcttgtgttcaatcgtgtgaatggccggcgggccccctccacgtccccatccttcgaggggacccaggagacctacacagtggcccacgaggagaatgtccgctttgtgtccgaagcctggcagcaggtgcaacagcagctggatggtggcccagccggtgagggcgggccaaggcctgtgcagtacgtggagaggacccccaatccccggctgcagaactttgtgcccattgacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtcaaaaagatagaaagaataacagatagaaatgaataccacatgagagggggcggcgcgcgtctctgagaagttattccctctgaggggggcgccccagatttgtacagcggtcacccatggtttccttgtgtgcaccaagggtgggccccatagatgggtgcgagagggtgcgcttgtaattcaccgcttggggaactcgtgggacaccgctggtttttacaacgcatgggctcgtggagcacggggcgaactgcgggtcccactctttgggggaaaccgtgtccggaaagggggcaaccccgtaaaatccaggggaggggggcagacacaacctaggtgggcacgagctccct

SEQ ID NO: 287157 - DNA, 1679 bp, Homo sapiens
agggggcaagcgccgcctccgccgcgtgtccggggtcagcccgagcccgtgcgggccctttaagggccgggggcgtgtagcgggcccgccccctccccgcggcgcccgcagtccgttaagtgcgagccccggcgcaggggccggatctggccgggggccggcggcggtgtgggagcggcgcgtcatgtacaccatcaccaaggggcccagcaagctggtcgcgcagcgccgcacaggtcccacgcagcagcaggtggagggccggctcggcgagctcctgaaatgccggcagcccgcgccgccgacctcgcagcccccgcgggcgcagccctttgcgcagccgccgggaccctggcccctgtcgagtgcccctctcagctgaggaggaaccgagagcggcgctggggcacctgagcccaggaaggcaacaggccggccgggaccgcgagtgcctggcggagcaggcgcagcccaggactcccggctcccacctccggctgtagtccagggccaaggcttgtgttcaatcgtgtgaatggccggcgggccccctccacgtccccatccttcgaggggacccaggagacctacacagtggcccacgaggagaatgtccgctttgtgtccgaaggtagcgagcggggccagagggtgcggcataggctgctgggtcgcaaaaccatggacccgggatggccccacttcaagctgacccacagccgctgcatggctgtgcttttccttggcactctgcccttgtgtcctgtgaccagccctgtgtggggctggagtccagggtgaccatcaggccctgggtgggcgatggggtgcctgggacctggctcagcccgactgccctcctcccacagcctggcagcaggtgcaacagcagctggatggtggcccagccggtgagggcgggccaaggcctgtgcagtacgtggagaggacccccaatccccggctgcagaactttgtgcccattgacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtcaaaaagatagaaagaataacagatagaaatgaataccacatgagagggggcggcgcgcgtctctgagaagttattccctctgaggggggcgccccagatttgtacagcggtcacccatggtttccttgtgtgcaccaagggtgggccccatagatgggtgcgagagggtgcgcttgtaattcaccgcttggggaactcgtgggacaccgctggtttttacaacgcatgggctcgtggagcacggggcgaactgcgggtcccactctttgggggaaaccgtgtccggaaagggggcaaccccgtaaaatccaggggaggggggcagacacaacctaggtgggcacgagctccct

SEQ ID NO: 287158 - DNA, 821 bp, Homo sapiens
agggggcaagcgccgcctccgccgcgtgtccggggtcagcccgagcccgtgcgggccctttaagggccgggggcgtgtagcgggcccgccccctccccgcggcgcccgcagtccgttaagtgcgagccccggcgcaggggccggatctggccgggggccggcggcggtgtgggagcggcgcgtcatgtacaccatcaccaaggggcccagcaagctggtcgcgcagcgccgcacaggtcccacgcagcagcaggtggagggccggctcggcgagctcctgaaatgccggcagcccgcgccgccgacctcgcagcccccgcgggcgcagccctttgcgcagccgccgggaccctggcccctgtcgagtccagggccaaggcttgtgttcaatcgtgtgaatggccggcgggccccctccacgtccccatccttcgaggggacccaggagacctacacagtggcccacgaggagaatgtccgctttgtgtccgaagcctggcagcaggtgcaacagcagctggatggtggcccagccggtgagggcgggccaaggcctgtgcagtacgtggagaggacccccaatccccggctgcagagccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtc

SEQ ID NO: 287159 - DNA, 951 bp, Homo sapiens
agggggcaagcgccgcctccgccgcgtgtccggggtcagcccgagcccgtgcgggccctttaagggccgggggcgtgtagcgggcccgccccctccccgcggcgcccgcagtccgttaagtgcgagccccggcgcaggggccggatctggccgggggccggcggcggtgtgggagcggcgcgtcatgtacaccatcaccaaggggcccagcaagctggtcgcgcagcgccgcacaggtcccacgcagcagcaggtggagggccggctcggcgagctcctgaaatgccggcagcccgcgccgccgacctcgcagcccccgcgggcgcagccctttgcgcagccgccgggaccctggcccctgtcgagtccagggccaaggcttgtgttcaatcgtgtgaatggccggcgggccccctccacgtccccatccttcgaggggacccaggagacctacacagtggcccacgaggagaatgtccgctttgtgtccgaagcctggcagcaggtgcaacagcagctggatggtggcccagccggtgagggcgggccaaggcctgtgcagtacgtggagaggacccccaatccccggctgcagaactttgtgcccattgacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtc

SEQ ID NO: 287160 - DNA, 823 bp, Homo sapiens
agggggcaagcgccgcctccgccgcgtgtccggggtcagcccgagcccgtgcgggccctttaagggccgggggcgtgtagcgggcccgccccctccccgcggcgcccgcagtccgttaagtgcgagccccggcgcaggggccggatctggccgggggccggcggcggtgtgggagcggcgcgtcatgtacaccatcaccaaggggcccagcaagctggtcgcgcagcgccgcacaggtcccacgcagcagcaggtggagggccggctcggcgagctcctgaaatgccggcagcccgcgccgccgacctcgcagcccccgcgggcgcagccctttgcgcagccgccgggaccctggcccctgtcgagcctggcagcaggtgcaacagcagctggatggtggcccagccggtgagggcgggccaaggcctgtgcagtacgtggagaggacccccaatccccggctgcagaactttgtgcccattgacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtc

SEQ ID NO: 287161 - DNA, 899 bp, Homo sapiens
agggggcaagcgccgcctccgccgcgtgtccggggtcagcccgagcccgtgcgggccctttaagggccgggggcgtgtagcgggcccgccccctccccgcggcgcccgcagtccgttaagtgcgagccccggcgcaggggccggatctggccgggggccggcggcggtgtgggagcggcgcgtcatgtacaccatcaccaaggggcccagcaagctggtcgcgcagcgccgcacaggtgcgcacgggccggggaacgggaacggggacggggcggggcgcggcggcggctgaccgccccccggtgcccgcaggtcccacgcagcagcaggtggagggccggctcggcgagctcctgaaatgccggcagcccgcgccgccgacctcgcagcccccgcgggcgcagccctttgcgcagccgccgggaccctggcccctgtcgagcctggcagcaggtgcaacagcagctggatggtggcccagccggtgagggcgggccaaggcctgtgcagtacgtggagaggacccccaatccccggctgcagaactttgtgcccattgacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtc

SEQ ID NO: 287162 - DNA, 875 bp, Homo sapiens
agggggcaagcgccgcctccgccgcgtgtccggggtcagcccgagcccgtgcgggccctttaagggccgggggcgtgtagcgggcccgccccctccccgcggcgcccgcagtccgttaagtgcgagccccggcgcaggggccggatctggccgggggccggcggcggtgtgggagcggcgcgtcatgtacaccatcaccaaggggcccagcaagctggtcgcgcagcgccgcacaggtcccacgcagcagcaggtggagggccggctcggcgagctcctgaaatgccggcagcccgcgccgccgacctcgcagcccccgcgggcgcagccctttgcgcagccgccgggaccctggcccctgtcgagcctggcagcaggtgcaacagcagctggatggtggcccagccggtgagggcgggccaaggcctgtgcagtacgtggagaggacccccaatccccggctgcagaactttgtgcccattgacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtcaaaaaaaaaaaaaaacaaaaaaaaaaaaaacaaaaaaacaaaaaaagggggg

SEQ ID NO: 287163 - DNA, 1088 bp, Homo sapiens
agggggcaagcgccgcctccgccgcgtgtccggggtcagcccgagcccgtgcgggccctttaagggccgggggcgtgtagcgggcccgccccctccccgcggcgcccgcagtccgttaagtgcgagccccggcgcaggggccggatctggccgggggccggcggcggtgtgggagcggcgcgtcatgtacaccatcaccaaggggcccagcaagctggtcgcgcagcgccgcacaggtcccacgcagcagcaggtggagggccggctcggcgagctcctgaaatgccggcagcccgcgccgccgacctcgcagcccccgcgggcgcagccctttgcgcagccgccgggaccctggcccctgtcgagtgcccctctcagctgaggaggaaccgagagcggcgctggggcacctgagcccaggaaggcaacaggccggccgggaccgcgagtgcctggcggagcaggcgcagcccaggactcccggctcccacctccggctgtagtccagggccaaggcttgtgttcaatcgtgtgaatggccggcgggccccctccacgtccccatccttcgaggggacccaggagacctacacagtggcccacgaggagaatgtccgctttgtgtccgaagcctggcagcaggtgcaacagcagctggatggtggcccagccggtgagggcgggccaaggcctgtgcagtacgtggagaggacccccaatccccggctgcagaactttgtgcccattgacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtc

SEQ ID NO: 287164 - DNA, 1164 bp, Homo sapiens
agggggcaagcgccgcctccgccgcgtgtccggggtcagcccgagcccgtgcgggccctttaagggccgggggcgtgtagcgggcccgccccctccccgcggcgcccgcagtccgttaagtgcgagccccggcgcaggggccggatctggccgggggccggcggcggtgtgggagcggcgcgtcatgtacaccatcaccaaggggcccagcaagctggtcgcgcagcgccgcacaggtgcgcacgggccggggaacgggaacggggacggggcggggcgcggcggcggctgaccgccccccggtgcccgcaggtcccacgcagcagcaggtggagggccggctcggcgagctcctgaaatgccggcagcccgcgccgccgacctcgcagcccccgcgggcgcagccctttgcgcagccgccgggaccctggcccctgtcgagtgcccctctcagctgaggaggaaccgagagcggcgctggggcacctgagcccaggaaggcaacaggccggccgggaccgcgagtgcctggcggagcaggcgcagcccaggactcccggctcccacctccggctgtagtccagggccaaggcttgtgttcaatcgtgtgaatggccggcgggccccctccacgtccccatccttcgaggggacccaggagacctacacagtggcccacgaggagaatgtccgctttgtgtccgaagcctggcagcaggtgcaacagcagctggatggtggcccagccggtgagggcgggccaaggcctgtgcagtacgtggagaggacccccaatccccggctgcagaactttgtgcccattgacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtc

SEQ ID NO: 287165 - DNA, 1323 bp, Homo sapiens
agggggcaagcgccgcctccgccgcgtgtccggggtcagcccgagcccgtgcgggccctttaagggccgggggcgtgtagcgggcccgccccctccccgcggcgcccgcagtccgttaagtgcgagccccggcgcaggggccggatctggccgggggccggcggcggtgtgggagcggcgcgtcatgtacaccatcaccaaggggcccagcaagctggtcgcgcagcgccgcacaggtcccacgcagcagcaggtggagggccggctcggcgagctcctgaaatgccggcagcccgcgccgccgacctcgcagcccccgcgggcgcagccctttgcgcagccgccgggaccctggcccctgtcgagtgcccctctcagctgaggaggaaccgagagcggcgctggggcacctgagcccaggaaggcaacaggccggccgggaccgcgagtgcctggcggagcaggcgcagcccaggactcccggctcccacctccggctgtagtccagggccaaggcttgtgttcaatcgtgtgaatggccggcgggccccctccacgtccccatccttcgaggggacccaggagacctacacagtggcccacgaggagaatgtccgctttgtgtccgaagcctggcagcaggtgcaacagcagctggatggtggcccagccggtgagggcgggccaaggcctgtgcagtacgtggagaggacccccaatccccggctgcagagtgagccccccaaccctgtccccccaggagagaccccccagcccctctgatcctgacccaggccctgccaggttcccaccccaggggatgagggaggggactcttgtgcagaaaccccttcttcccagcgcctgccgcactcggagtccgggtgagcggcttgtggttagctccaggggagacttgccggctggcctgggaggcagcatcactgcccagccttctctgcccacagactttgtgcccattgacctagacgagtggtgggcgcagcagttcctggcgagaatcaccagctgttcctagtggctgctgggagggggcgctgctacacggccgacctgtcgccaggagagaagcatggcgccctgcccacccactgcgcctggctgggtgccggccacacctgaagtgccagcatttggacttttgcacctttttttcccttggcccggctgtcccaaccaagctgccatggccaagggccgaacccgtctgacctcagccctgctcactgtgcccagggaccagcgaccagcccctggggctggcagggaggagctccaggctaataaagtggagaaactgtc

SEQ ID NO: 287166 - DNA, 396 bp, Homo sapiens
aatgaacaagttagtatattttgcctaatttggtaagtgtctattctatgcttcaaggacagctcttgaagaaaagattaaatcatggtcagaaaccttgcattaaaataataataataacagtgataatgttcttaacataattctgttactgcattaggtgttagaatttcataatttttttttttttatttttcccttaagcttaggaaagttgttccaaaatagggatgccaaccttatttccccatagctgtaagttttttgagatgcataaatgatacagtttagaatgaagagctcaataatttcctcctttttctttactgaaggaaaattcgggaggtggggcagatgtgtatttaaggagattacaagggtgactttagagccaaa

SEQ ID NO: 287167 - DNA, 1123 bp, Homo sapiens
gaaaagaaaagaaaaagaaaatcctttaactgacttcatcttaaccttttagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaa

SEQ ID NO: 287168 - DNA, 406 bp, Homo sapiens
gcggccgcctactactactactgctcgaattcaagcttctacggggacatgagccctggccaggacagtaccagttttctgaggaccatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaa

SEQ ID NO: 287169 - DNA, 2040 bp, Homo sapiens
aactttagattttttagaattgtactaaaagcaaactgttttcttggatatttgttctttctccccaaaagatgatttataagttttcagagctaagaaatgggaaggaagagccatcctagcatggcagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaa

SEQ ID NO: 287170 - DNA, 1160 bp, Homo sapiens
gcgggtgtgccagattccaccctcctgccccgcgcgccttccctctcctcggaccctctctgtttcctaggagcgcgtgtctgatactctcaaggaacggagctggaatagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaa

SEQ ID NO: 287171 - DNA, 2005 bp, Homo sapiens
ggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgcagaccaattggtgcttccgaccgaacgctctcagcccccagcggacgcgcgcaattcaatacgttggtcaggagtgggcgcgcacggcgcccgccggg

SEQ ID NO: 287172 - DNA, 590 bp, Homo sapiens
acataaaggttcttggtttgtaaaaatttattaaatggttcactgatttgtgtactttttttatatgtgaatactgcaataaggttttttattgcactgttttcagtttgttgaacagaaaaagggagactctttttgttgtttttgacctctcgacctcataatggcaatgtaggcaagaacattccctcaaggcaatacctgtgggtgtcttggttatattccaccggaaacaaagacagaggctgtccttataaaatatgtttgaagacctgtgaaactttaatagtgccttttattccatataggacagcacaattacctatgtgctggaaggaatgattgcatcatcgataaaattcgaagaaaaaactgcccagcatgccgctatcgaaaatgtcttcaggctggaatgaacctggaaggtaatataaatatctgaaagcaattgtttgtctctgtagcttataaaaatttatcattttacttttgaagatacacgtaagcagatgtaattaatgtagtcagttcagtatatatatgcttgactagcataatgttactgcccaataaaaatgggaaattttttt

SEQ ID NO: 287173 - DNA, 1998 bp, Homo sapiens
ggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaa

SEQ ID NO: 287174 - DNA, 1946 bp, Homo sapiens
ggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaa

SEQ ID NO: 287175 - DNA, 599 bp, Homo sapiens
ggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggtagtgtgtgttttgaagagtttatttttcctctacttggttttcatttctcagggtggattttgaaatttccattatatgcaaagcccatgaaaggctaaatatcagttaagaggggagaggagggtggctcctaggtcctctaatgggcaggaaagtatttaaaacgacaatacaaaaagatctagaataaaatagaaaagtacaagttgatgtctgggagtttggtcagggagcataaggtaacactataagaaagtgctatcatatgaaatgatggtgttaagtttgggcataacataatgttcattgtattagaaacatgggctttaacttccataagc

SEQ ID NO: 287176 - DNA, 1050 bp, Homo sapiens
caagactctgtctcaaaaaaaaaaaaaaaaaaagtaacatttatttcatgctatacagctatgtgttttcatgcaataattttaagtattatggtatacattttcataagaggagcaaataaatcccaatataattttaaaataaagatatatattaagtatctttaatatttttaatgcatttgacaataccatatgctgtttttgatgacaaatttcattttggtacatggcagatttgtccttttggtactgaactgaagaaaaaacatgtcacacctgaaattctgccttaagtgagtaaaaccatggtcaactacatcaatagatttcagccaaccagcaaaattgaaatgttttagtcattcttattatttataataaaaatgaaacaagattaatagtcaacaggagagaatagttaatatcatcagtttaaaacaggtctttttattttttcgagatagtgtcttgctctattgtccaggctggagtgcagtggtgtgatcacagctcactgcagcctcaacctcccaggctcaagctatcctcccttctcagcctccaagtagttaggactacaggcacgtgccatcatgcctggctaattttttattttctataaagatggggtctcactctgttgcctaggctggtctcaaactcctggtctcaaccttccaaaatggtgggattacaggtgtgagccactgcacccaacctaaaataggacttaaagcagattacttataccacatattcaaaagaaaataatatttggaaatgtaagatatcaatctgaactgaaaacatttttaatattaattcctgtctctccaatgcagccaactttcatatgatagtgtgaggttgatcacatctaatctatgcaaaaatgggtatcttcttcatgttatccaccatttctcaactagtctctatattaatttacacaattatttcacagagattaataaaacatcagataatagaatcaacccaaaaggcaacagcatttttctttctacaagggaacatggctttcaatgt

SEQ ID NO: 287177 - DNA, 805 bp, Homo sapiens
aaattcaaaaatatttttggttattattgagtgtagtctgaataacctctcacccaatactttacagtaacccatacacacatgaaattatgtattgatttcctaattcattgggaaaaaaattaacattctcccagagtagtaaacaatcacatagtatttttccacataaaatattctattacacccatcaatactgacctaggtagggagaaaataattctgaatccagcagagtaccaaaaaagctttttaatgcactatttgttttccaggcaaaagatcttcagaaaatatccgtcatttagtagacttacaaatggcacttttggctacataggagaatcagatatgagacccacgtgttttttctgataagctagtagtaggtcagctttataatacaaccctttcttagaataaaaaatggctaatttgttttaaaagacaggaaaagctgaaaccctaaagtcattgttttaaaaaatgtggggccaggcgcagtggccacatattcaaaagaaaataatatttggaaatgtaagatatcaatctgaactgaaaacatttttaatattaattcctgtctctccaatgcagccaactttcatatgatagtgtgaggttgatcacatctaatctatgcaaaaatgggtatcttcttcatgttatccaccatttctcaactagtctctatattaatttacacaattatttcacagagattaataaaacatcagataatagaatcaacccaaaaggcaacagcatttttctttctacaagggaacatggctttcaatgt

SEQ ID NO: 287178 - DNA, 1257 bp, Homo sapiens
aaattcaaaaatatttttggttattattgagtgtagtctgaataacctctcacccaatactttacagtaacccatacacacatgaaattatgtattgatttcctaattcattgggaaaaaaattaacattctcccagagtagtaaacaatcacatagtatttttccacataaaatattctattacacccatcaatactgacctaggtagggagaaaataattctgaatccagcagagtaccaaaaaagctttttaatgcactatttgttttccaggcaaaagatcttcagaaaatatccgtcatttagtagacttacaaatggcacttttggctacataggagaatcagatatgagacccacgtgttttttctgataagctagtagtaggtcagctttataatacaaccctttcttagaataaaaaatggctaatttgttttaaaagacaggaaaagctgaaaccctaaagtcattgttttaaaaaatgtggggccaggcgcagtggctcacacctgtaatcccagcaccttgaggtgggtttttagacaacaatagagagctgacacactactctgtggcaggaattgtgccaggtgaagaaaataccctggatactaagacatagcccctgttctgcagatgcttagagtctacttaggcaaacagacatgtaacaggggaatttcaaagtaaatgtcatcagtgctctaacggggcatagggaggacttaaggatccatgtaaatttagagaagaggcatcaatcctagaactggggagctggtgaaggcttctcagaggagataatttctaaagggagtttacatgaagaaagaattttccaggcaacagtaagacagaacattcttctttccacgaagaagaaagtacatgtgcaagggctggagggagtgagatagggtccccaggaaggtaggggtagtctttttaattgctgtgtaaagatgtcaggggtgggctggaggagtagctaagggaaagctctcatggcctttggcttttgaacttagggtgatgggaaccaaagaaggaaatcctctctcccttctttccttccttcctcacagccaagaggagatcgtgtgcaatagatacagagaaatgcttctctggtgcttaggttggctgaagggaagttctattatgccagggtccaagataatggtatcttcttcttgcctgctttacccattatcttggacctggctgaagggaagttctattatgccaccca

SEQ ID NO: 287179 - DNA, 706 bp, Homo sapiens
aaattcaaaaatatttttggttattattgagtgtagtctgaataacctctcacccaatactttacagtaacccatacacacatgaaattatgtattgatttcctaattcattgggaaaaaaattaacattctcccagagtagtaaacaatcacatagtatttttccacataaaatattctattacacccatcaatactgacctaggtagggagaaaataattctgaatccagcagagtaccaaaaaagctttttaatgcactatttgttttccaggcaaaagatcttcagaaaatatccgtcatttagtagacttacaaatggcacttttggctacataggagaatcagatatgagacccacgtgttttttctgataagctagtagtaggtcagctttataatacaaccctttcttagaataaaaaatggctaatttgttttaaaagacaggaaaagctgaaaccctaaagtcattgttttaaaaaatgtggggccaggcgcagtggctcacacctgtaatcccagcactttgggaggccgaggcgggcagatcacgaagtcaagagatcgagaccatcctggccaacatggtgaaaccctgtctctactaaaaatacaaaaaattagctgggcgtggtggtgcgtgcctgtagtcccagctactcaagaggttcaggcaggagaatcacttgaacctgggaggcg

SEQ ID NO: 287180 - DNA, 1203 bp, Homo sapiens
aaattcaaaaatatttttggttattattgagtgtagtctgaataacctctcacccaatactttacagtaacccatacacacatgaaattatgtattgatttcctaattcattgggaaaaaaattaacattctcccagagtagtaaacaatcacatagtatttttccacataaaatattctattacacccatcaatactgacctaggtagggagaaaataattctgaatccagcagagtaccaaaaaagctttttaatgcactatttgttttccaggcaaaagatcttcagatcagatatgagacccacgtgttttttctgataagctagtagtaggtcagctttataatacaaccctttcttagaataaaaaatggctaatttgttttaaaagacaggaaaagctgaaaccctaaagtcattgttttaaaaaatgtggggccaggcgcagtggctcacacctgtaatcccagcaccttgaggtgggtttttagacaacaatagagagctgacacactactctgtggcaggaattgtgccaggtgaagaaaataccctggatactaagacatagcccctgttctgcagatgcttagagtctacttaggcaaacagacatgtaacaggggaatttcaaagtaaatgtcatcagtgctctaacggggcatagggaggacttaaggatccatgtaaatttagagaagaggcatcaatcctagaactggggagctggtgaaggcttctcagaggagataatttctaaagggagtttacatgaagaaagaattttccaggcaacagtaagacagaacattcttctttccacgaagaagaaagtacatgtgcaagggctggagggagtgagatagggtccccaggaaggtaggggtagtctttttaattgctgtgtaaagatgtcaggggtgggctggaggagtagctaagggaaagctctcatggcctttggcttttgaacttagggtgatgggaaccaaagaaggaaatcctctctcccttctttccttccttcctcacagccaagaggagatcgtgtgcaatagatacagagaaatgcttctctggtgcttaggttggctgaagggaagttctattatgccagggtccaagataatggtatcttcttcttgcctgctttacccattatcttggacctggctgaagggaagttctattatgccaccca

SEQ ID NO: 287181 - DNA, 907 bp, Homo sapiens
aaattcaaaaatatttttggttattattgagtgtagtctgaataacctctcacccaatactttacagtaacccatacacacatgaaattatgtattgatttcctaattcattgggaaaaaaattaacattctcccagagtagtaaacaatcacatagtatttttccacataaaatattctattacacccatcaatactgacctaggtagggagaaaataattctgaatccagcagagtaccaaaaaagctttttaatgcactatttgttttccaggcaaaagatcttcagaaaatatccgtcatttagtagacttacaaatggcacttttggctacataggagaatcagatatgagacccacgtgttttttctgataagctagtagtaggtcagctttataatacaaccctttcttagaataaaaaatggctaatttgttttaaaagacaggaaaagctgaaaccctaaagtcattgttttaaaaaatgtggggccaggcgcagtggcacagaacattcttctttccacgaagaagaaagtacatgtgcaagggctggagggagtgagatagggtccccaggaaggtaggggtagtctttttaattgctgtgtaaagatgtcaggggtgggctggaggagtagctaagggaaagctctcatggcctttggcttttgaacttagggtgatgggaaccaaagaaggaaatcctctctcccttctttccttccttcctcacagccaagaggagatcgtgtgcaatagatacagagaaatgcttctctggtgcttaggttggctgaagggaagttctattatgccagggtccaagataatggtatcttcttcttgcctgctttacccattatcttggacctggctgaagggaagttctattatgccaccca

SEQ ID NO: 287182 - DNA, 555 bp, Homo sapiens
ctgcatggtccctgagctgtccctgcaggactccagtggaagtgaaagaactgggcaccggggaaaagctaggatgtcccacactcctacaccatgcagggaactcgggcacaggccggctgggccgggatcagatgggaagcagaagctcatcatgaccagaaactgtttccctacggagagcacttggagatggcaatgctgaacctcacactgtaggactcacacacgactctaacgggattgtaagaatcaagtcactctcatgggaagaatttttatatgggaaagcggctaaaactttcattggactggaatgtttggagattgttaaattccaaatcaggaaccacaaactgccctctaataagatatcagctgtctaagcgtgtgggtgccgcctttctgccagtagttctggttcttaagaaaagcaccataaatcagacatgaaaattctggctccaaaaatagcattttctttgtgcaaataaaaacgtgtgtatcaagtatgacgttcccccaacgtggacacacttggttcctcagaaagcc

SEQ ID NO: 287183 - DNA, 670 bp, Homo sapiens
ccctggccccgcgtaggcagaccgtgggctcgctcctgggcctgcctcaaaccctccgcagtaacctgaagctttcaccgtagacgtgctgtattgcccagaagccatcgtgtcgctggtcggggtcctgcggaggctggctgcctgccaggagcacaagcgggctcctgaggtctacgtggcctttaccgtccgcaacccagagacgtgccagctgttcaccaccgagctaggctgggccgggatcagatgggaagcagaagctcatcatgaccagaaactgtttccctacggagagcacttggagatggcaatgctgaacctcacactgtaggactcacacacgactctaacgggattgtaagaatcaagtcactctcatgggaagaatttttatatgggaaagcggctaaaactttcattggactggaatgtttggagattgttaaattccaaatcaggaaccacaaactgccctctaataagatatcagctgtctaagcgtgtgggtgccgcctttctgccagtagttctggttcttaagaaaagcaccataaatcagacatgaaaattctggctccaaaaatagcattttctttgtgcaaataaaaacgtgtgtatcaagtatgacgttcccccaacgtggacacacttggttcctcagaaagcc

SEQ ID NO: 287184 - DNA, 934 bp, Homo sapiens
cggcgcgcacactgcgctccttcccctggcatgtgggcggcggggcgagcggagaggcccgcggggctcgcgggagtccaggggcagacgggatgggtctccgtgctgaaacccccggcgctccggctacactgtgaagcatcctgtgtgtgtgtgaagcacccgccgtcagtcaagtatgcccggtgctttctctcagaactcatcaaaaagccctcgggaggctcggtcacaatctccgagagcacagccatcatctctcacggtaccacaggcctggtcacatgggacgccaccctctgccttgcagaatgggccatcgagaacccagcagccttcactaacagacgtgctgtattgcccagaagccatcgtgtcgctggtcggggtcctgcggaggctggctgcctgccaggagcacaagcgggctcctgaggtctacgtggcctttaccgtccgcaacccagagacgtgccagctgttcaccaccgagctaggctgggccgggatcagatgggaagcagaagctcatcatgaccagaaactgtttccctacggagagcacttggagatggcaatgctgaacctcacactgtaggactcacacacgactctaacgggattgtaagaatcaagtcactctcatgggaagaatttttatatgggaaagcggctaaaactttcattggactggaatgtttggagattgttaaattccaaatcaggaaccacaaactgccctctaataagatatcagctgtctaagcgtgtgggtgccgcctttctgccagtagttctggttcttaagaaaagcaccataaatcagacatgaaaattctggctccaaaaatagcattttctttgtgcaaataaaaacgtgtgtatcaagtatgacgttcccccaacgtggacacacttggttcctcagaaagcc

SEQ ID NO: 287185 - DNA, 987 bp, Homo sapiens
gtttgcgggaacaaagcagcgccctgcggaaggcagccctcgtgaactcagaagttagttttcgtctctggacctttttataatcggacttcagcccatcactgtctcgttttgtcctcagaaacggcgacagcagcctcttcccaatgttgagagcaaaaagtgtgaacccagaaattccgagacagatctcaattacttgccaaggttgaggacgcgcgcgtgacagcctcaggaagtcctcacgacatgtgcccaaggtggtctgggcatagcttagttttatacattttatggagacatgagacatcaataaatgtatgtaagaagtacattggttctgtttggaaaggcggggcaacttgaagcaaaggcaggaagacgtgaagcaggaagggggcttccaagaaacagaagagacaagtgaacatttatttttatgtctttcttcctatgtgtatttcaagtctttttcaaaacaaggccccaggactctccagattcaattatgtccttgggcttggtcgactgctgcaggagtcttaaggagccttgtgcaaatgctagagtgactcatttaccaacattaaaccctaggatagatgcaacagagaagtactacttcctccatggaatgtgctgatttcaggcgacgtggcacccaatgtagaaaacgctggaatttttccttggaactggactgtgatgagaggtgcttgccatgaacataagctactgtcttttttttctttttttgagacggactttcactttttttgcccaggctggagtgtaatggcgcgatcttggctcaccgcaacctccgcctcccaggtttgagtgattctcctaccttagcctcctgagtagctgggattacaggcgtgcgccaccattcccagctaatttttgtatttttagtagacacagtgtttctccatgttggtcaggctggtctcaaactcctgacctcaggtgatacgcccg

SEQ ID NO: 287186 - DNA, 413 bp, Homo sapiens
tatttcttttcttttttttttttttgcagagacaagtgaacatttatttttatgtctttcttcctatgtgtatttcaagtctttttcaaaacaaggccccaggactctccagattcaattatgtccttgggcttggtcgactgctgcaggagtcttaaggagccttgtgcaaatgctagagtgactcatttaccaacattaaaccctaggatagatgcaacagagaagtactacttcctccatggaatgtgctgatttcaggcgacgtggcacccaatgtagaaaacgctggaatttttccttggaactggactgtgatgagaggtgcttgccatgaacataagctactgtcttttttttctttttttgagacggactttcactttttttgcccaggctggagtgtaatggcg

SEQ ID NO: 287187 - DNA, 491 bp, Homo sapiens
ttttttttttgagacggagtctcggtctgtcgcccaggctggagtgcagtggtgcgatctcggctcactgcaagctccgcctcccgggttcacgccattctcctgcctcagcctccggagtagctgggactacagggtctcactgtgttgcccaggctggagtgcagtggcatgatcgcgactcctgcagcctcaatctccctcccaggatgaagtgatcctcctgcctctaggaccacaggtggccctgaagctcctcgtcctcctccagctgcggggtcaggccatcggtgtcgtcctctggaacagagccaagcccaccccaggggagtccgtggaaggtgaaggaggccaaggccgccccaggctccctgcgggtcaccaccttctctgtccagttccgggaaagcactggccgtcctgcctgcctgtggctgttcctgctacagccctaagcaggctccacagcagcacagcacacccctctccag

SEQ ID NO: 287188 - DNA, 493 bp, Homo sapiens
gcggccgccgagcgcatactggacggcggcccacagttcactcctcaggcgcggaggaaatggtggaaggcccagctctgggtgatcctgggcgctgcccccgttacccgttaccaggaagaaggactcctgaccttcaggctcagtgtggctcggtcatattcgaacacccggatggctggattgttggccccattgaccactccagagcatccgaaagctgtcggtgtggtggtgcccgaagaactgccctgctatgacgcgatgatgcttccggaccaccttcagatgaggaaactgagcgagtgagcggcagaccggggatgccgagcacgtcagaatggaaatgatcacagtgcactatattctgccaccacctaccagcatggccttggagatatatacaggttttccttgacttacaatggggctacgtcccccaaaattgaaaatatcataagtcaaaaatgcattcaacacacccaacctacca

SEQ ID NO: 287189 - DNA, 1078 bp, Homo sapiens
agactgacctgcggcccgccagaccctcggcgcggccgccggacgccgcggggcggacgcggaagtgaacgccttctcagctgctcggcaactcgggagcagagcggccccagcggcgcccccgtgcggcccggctctgaggcagcggctcagggagggagggaggccacgtcccgggcacgccacgccacgccacgccccgcccccagattcgtctcgccccagtgggccgcctcggagtcgggtgggtcttccatcccggaggacccgattggctgatggggcaaccgccaacggctgtggcgtttaaacccaagccgcagccgctgctgctcgccgagctcccggagctgggtgggggtgccccacgctgaaagagagtgatggagtgcccagtgatggaaactggctcactttttacctcaggaattaagagacatttgaaagacaaaagaatttcaaagactactaagttgaatgtttctcttgcttcaaaaataaaaacaaaaatactaaataattcttctattttcaaaatatctttaaagcacaacaacagggcattagctcaggctcttagtagagaaaaagagaattctcgaagaattacaactgaaaagatgctattgcaaaaagaagtagagaaactgaattttgagaacacatttcttcgcctaaagctaaataacttgaataagaagcttatagacatagaagctctcatgaacaataacttgataactgcaattgaaatgagcagtctttctgagttccatcagagttcctttctactgtcagctagcaagaagaaacgaattagtaaacagtgcaagttgatgcgtcttccatttgcaagggttccattaacttcaaatgatgatgaagatgaagataaagagaaaatgccgtgtgacaaccatattaaatcaaagacattacctgatattccctcttcaggatcaacaacacaacctttatcaactcaggataatcggaagtgtttctttcagcaatcaccacgttttgggagattcaccattcccctagggtgagcccaaaaactcccctgaccagtaag

SEQ ID NO: 287190 - DNA, 1381 bp, Homo sapiens
agactgacctgcggcccgccagaccctcggcgcggccgccggacgccgcggggcggacgcggaagtgaacgccttctcagctgctcggcaactcgggagcagagcggccccagcggcgcccccgtgcggcccggctctgaggcagcggctcagggagggagggaggccacgtcccgggcacgccacgccacgccacgccccgcccccagattcgtctcgccccagtgggccgcctcggagtcgggtgggtcttccatcccggaggacccgattggctgatggggcaaccgccaacggctgtggcgtttaaacccaagccgcagccgctgctgctcgccgagctcccggagctgggtgggggtgccccacgctgaaagagagtgatggagtgcccagtgatggaaactggctcactttttacctcaggaattaagagacatttgaaagacaaaagaatttcaaagactactaagttgaatgtttctcttgcttcaaaaataaaaacaaaaatactaaataattcttctattttcaaaatatctttaaagcacaacaacagggcattagctcaggctcttagtagagaaaaagagaattctcgaagaattacaactgaaaagatgctattgcaaaaagaagtagagaaactgaattttgagaacacatttcttcgcctaaagctaaataacttgaataagaagcttatagacatagaagctctcatgaacaataacttgataactgcaattgaaatgagcagtctttctgagttccatcagagttcctttctactgtcagctagcaagaagaaacgaattagtaaacagtgcaagttgatgcgtcttccatttgcaagcaggacgtggtggctcatgcctgtaatcccagcactttgggaggctgaggcaggaggatcacgaggtcaggaaatcgagaccatcctggctaacatggtgaaaccccgtctctactaaaaatacaaaaaattagccgggtgtggtggcgggcacctgtagtcctagctacttgggaggctgaggcaggagaatggtgtgaactcgggaggcagagcttgcagtgagccgagattgcgccactgcgctccagcctgggcgacagagcaagactctgtctcaaaaaaacaaacaaacaaaattaacttttgtctttgctcttatcctcctgtgcacaattctcattttttattaatttgattataagttatagaaagcaccctatttcaaatctgtcatcttacaagtcagtcagtgatgctcagagaggcaaaatgattgaatgaattgatagcattgaccaaaatcctgttgtctcttttagaaatgttctttctattatatataacatatagatttaatgcttt

SEQ ID NO: 287191 - DNA, 315 bp, Homo sapiens
gctcaggctcttagtagagaaaaagagaattctcgaagaattacaactgaaaagatgctattgcaaaaagaagtagagaaactgaattttgagaacacatttcttcgcctaaagctaaataacttggtatgtaagctatattgtttttgaattctaattataacttaaatcttttagctgcattattatagaagctttaaaaatatttttcaaatctccaatagtgaaaaattattgaaagtcagtataccatgtaagtctatgtcaaagtacaaactgttaatgggtaataaaatatgtgttttaaatctacat

SEQ ID NO: 287192 - DNA, 2799 bp, Homo sapiens
agcgggtagtataaccgtcctcagccataagcctgtcccatcgagacgtcgggacaccgaaaactaccattcccgccggcaaagcggctccggcctctcagcacacttccctccccatggcctctgttcatccccctgcctcagttctggtacctggggtcaaatcggctgtagtggttgactctcagggcacccgctgccgggtcccagtccacctttgctactttgtcctactcccagcccgcgggcgctaggctcgggggcgtggcgcatccctgactccgcccccgccgcgggggggcctctggggcctggtcgccatggcgaccggctgtacgctaccacagcttcccaggccgcgggtgctgattgcccgcctgcccgtgggtcatggcctgccagcagtcgcggtaccacagcttctcgtccgcgtcgaggtaggcgctggcagggatgagggcagagatgagggtttgagtacttctagagagggaaatggcacttgatccggacctctgcacctcctgctggcctctgaccattgatctagggctccagcaccacagagtcaatggttagaatcgggctgatttagcccagtgaagacgttacgtgctagcaaaacgattacagccacggccttcaggagtgaccatagacgaatcctttctcacagaagacaagagcacccagaatcgcaagcttcttcagaaacgaaggacgctgactggtcagttctccatgggtgggcacctgtccccatggcccacatacaccagtggccagaccattttgcaaaatcgaaaaccctgttcagatgactaccggaagcgagtagggagctgccagcagcacccctttcgcactgccaagccccagtacttggaggaactggaaaactacctacgcaaggagctcctcctgctggacctgggcacagattccacccaggaactaaggctgcagccttacagagagatctttgagttcttcatagaggacttcaaaacgtacaagccattactatcctccatcaagaatgcgtatgaggggatgctggcccaccaaagggagaagattcgggctctggagcccctgaaggccaagcttgtcactgtgaatgaggactgcaatgagaggatcctggccatgagagctgaggagaaatatgaaatctccctgctcaagaaagagaagatgaacttgctaaaactcatcgacaaaaagaatgaggagaagatttcattgcagagcgaggtgaccaaactgaggaagaacttggctgaggagtacctgcactacctcagtgagcgagatgcctgtaagatcctcatcgcagacctgaatgagctgcggtaccagcgggaggacatgtcattagcccagtcgccaggcatctggggggaggaccctgtgaagttaaccctggctcttaagatgacccggcaagacctgacccgcacgcagatggaactcaacaacatgaaggccaactttggagatgtggtccccaggagggactttgaaatgcaggagaagaccaacaaggatcttcaggagcagctggacaccctgagagccagctacgaggaggttcgcaaggagcatgagatcctcatgcagctgcacatgagcacgctgaaggaacgggaccaattcttctctgagctgcaggagatccagcgcacttccacgccgcggcctgactggaccaagtgcaaagatgtggtggctgggggcccagagcgctggcagatgctggctgagggcaagaacagcgaccagctggtggacgtgctcctggaagagattggttcggggctgctgcgggagaaagacttcttccctggtctgggctatggggaagccatccctgcttttcttcggtttgatggcctcgtggagaacaagaagccaagcaagaaggacgtggtcaacctcctcaaggatgcctggaaggaacgtcttgctgaggagcagaaagagacgttcccagatttcttcttcaatttcctggagcatcgctttgggcccagtgatgccatggcctgggcttatactatttttgaaaatatcaagatcttccactccaacgaggttatgagtcagttctatgcagtcttgatgggaaagcggagtgagaatgtgtatgtcacccagaaggagacagtagcccagctgctgaaggagatgacaaatgctgacagtcagaacgaggggctactaaccatggagcagttcaacactgtcctcaagagtaccttccctctcaagacagaagagcaaatccaggagctgatggaggcagggggctggcatcccagcagcagcaatgcagacttgctcaactaccgctcactgtttatggaggatgaggagggccagagtgagccctttgtgcaaaaactctgggaacaatacatggatgagaaggacgagtacttacagcagctaaagcaggagcttggcatagaactccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcaggtgattgacatcaggcgtgtgggacctcgagagccagagcctgcaagctaggaacttgtgggcagcctgcgtactccagtcctgctaacccctagcttttaatataaaagtgtttgtctgaaaacaaaaaat

SEQ ID NO: 287193 - DNA, 419 bp, Homo sapiens
cccactgaccagagttgctcgctgtccttgaccccaccgagaggggtgcaaccctgactcagcatcacctcctatctgtcatagcggggagagctttccccaaaggccagcaggggaaaacccaaccttacttggaggagccagggaagtatctcgcagatcccgcaaaaaggcacccacgtctacagctcggcgggctggaggtctgcgggccaagccaggcctctgcactgactgtggctgaagaggtgtggcaaaggtcaggttgagggatctggtgagggaagaggcatcagcattcccttgaggctcttgggagagagacagcccctggtccactccctgctgaaacactgacagtctcagcctctgtttcctcctgccaggggccagcagacctggagccagggttgtggggg

SEQ ID NO: 287194 - DNA, 2765 bp, Homo sapiens
agcgggtagtataaccgtcctcagccataagcctgtcccatcgagacgtcgggacaccgaaaactaccattcccgccggcaaagcggctccggcctctcagcacacttccctccccatggcctctgttcatccccctgcctcagttctggtacctggggtcaaatcggctgtagtggttgactctcagggcacccgctgccgggtcccagtccacctttgctactttgtcctactcccagcccgcgggcgctaggctcgggggcgtggcgcatccctgactccgcccccgccgcgggggggcctctggggcctggtcgccatggcgaccggctgtacgctaccacagcttcccaggccgcgggtgctgattgcccgcctgcccgtgggtcatggcctgccagcagtcgcggtaccacagcttctcgtccgcgtcgagattacagccacggccttcaggagtgaccatagacgaatcctttctcacagaagacaagagcacccagaatcgcaagcttcttcagaaacgaaggacgctgactggtcagttctccatgggtgggcacctgtccccatggcccacatacaccagtggccagaccattttgcaaaatcgaaaaccctgttcagatgactaccggaagcgagtagggagctgccagcagcacccctttcgcactgccaagccccagtacttggaggaactggaaaactacctacgcaaggagctcctcctgctggacctgggcacagattccacccaggaactaaggctgcagccttacagagagatctttgagttcttcatagaggacttcaaaacgtacaagccattactatcctccatcaagaatgcgtatgaggggatgctggcccaccaaagggagaagattcgggctctggagcccctgaaggccaagcttgtcactgtgaatgaggactgcaatgagaggatcctggccatgagagctgaggagaaatatgaaatctccctgctcaagaaagagaagatgaacttgctaaaactcatcgacaaaaagaatgaggagaagatttcattgcagagcgaggtgaccaaactgaggaagaacttggctgaggagtacctgcactacctcagtgagcgagatgcctgtaagatcctcatcgcagacctgaatgagctgcggtaccagcgggaggacatgtcattagcccagtcgccaggcatctggggggaggaccctgtgaagttaaccctggctcttaagatgacccggcaagacctgacccgcacgcagatggaactcaacaacatgaaggccaactttggagatgtggtccccaggagggactttgaaatgcaggagaagaccaacaaggatcttcaggagcaggtgctggcaggcaggcagggccaggagggtaggacggggtctcacaggtggggggccagggccaatgtccttgcccacagctggacaccctgagagccagctacgaggaggttcgcaaggagcatgagatcctcatgcagctgcacatgagcacgctgaaggaacgggaccaattcttctctgagctgcaggagatccagcgcacttccacgccgcggcctgactggaccaagtgcaaaggtgagggcagccggcagggccccaggtcctgcttacatgtgggcccagactccagctccctctccccacatgcagatgtggtggctgggggcccagagcgctggcagatgctggctgagggcaagaacagcgaccagctggtggacgtgctcctggaagagattggttcggggctgctgcgggagaaagacttcttccctggtctgggctatggggaagccatccctgcttttcttcggtttgatggcctcgtggagaacaagaagccaagcaagaaggacgtggtcaacctcctcaaggatgcctggaaggaacgtcttgctgaggagcagaaagagacgttcccagatttcttcttcaatttcctggagcatcgctttgggcccagtgatgccatggcctgggcttatactatttttgaaaatatcaagatcttccactccaacgaggttatgagtcagttctatgcagtcttgatgggaaagcggagtgagaatgtgtatgtcacccagaaggagacagtagcccagctgctgaaggagatgacaaatgctgacagtcagaacgaggggctactaaccatggagcagttcaacactgtcctcaagagtaccttccctctcaagacagaagagcaaatccaggagctgatggaggcagggggctggcatcccagcagcagcaatgcagacttgctcaactaccgctcactgtttatggaggatgaggagggccagagtgagccctttgtgcaaaaactctgggaacaatacatggatgagaaggacgagtacttacagcagctaaagcaggagcttggcatagaactccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcaggtgattgacatcaggcgtgtgggacctcgagagccagagcctgcaagctaggaacttgtgggcagcctgcgtactccagtcctgctaacccctagcttttaatataaaagtgtttgtctgaaaacaaaaaat

SEQ ID NO: 287195 - DNA, 2431 bp, Homo sapiens
agcgggtagtataaccgtcctcagccataagcctgtcccatcgagacgtcgggacaccgaaaactaccattcccgccggcaaagcggctccggcctctcagcacacttccctccccatggcctctgttcatccccctgcctcagttctggtacctggggtcaaatcggctgtagtggttgactctcagggcacccgctgccgggtcccagtccacctttgctactttgtcctactcccagcccgcgggcgctaggctcgggggcgtggcgcatccctgactccgcccccgccgcgggggggcctctggggcctggtcgccatggcgaccggctgtacgctaccacagcttcccaggccgcgggtgctgattgcccgcctgcccgtgggtcatggcctgccagcagtcgcggtaccacagcttctcgtccgcgtcgagattacagccacggccttcaggagtgaccatagacgaatcctttctcacagaagacaagagcacccagaatcgcaagcttcttcagaaacgaaggacgctgactggtcagttctccatgggtgggcacctgtccccatggcccacatacaccagtggccagaccattttgcaaaatcgaaaaccctgttcagatgactaccggaagcgagtagggagctgccagcagcacccctttcgcactgccaagccccagtacttggaggaactggaaaactacctacgcaaggagctcctcctgctggacctgggcacagattccacccaggaactaaggctgcagccttacagagagatctttgagttcttcatagaggacttcaaaacgtacaagccattactatcctccatcaagaatgcgtatgaggggatgctggcccaccaaagggagaagattcgggctctggagcccctgaaggccaagcttgtcactgtgaatgaggactgcaatgagaggatcctggccatgagagctgaggagaaatatgaaatctccctgctcaagaaagagaagatgaacttgctaaaactcatcgacaaaaagaatgaggagaagatttcattgcagagcgaggtgaccaaactgaggaagaacttggctgaggagtacctgcactacctcagtgagcgagatgcctgtaagatcctcatcgcagacctgaatgagctgcggtaccagcgggaggacatgtcattagcccagtcgccaggcatctggggggaggaccctgtgaagttaaccctggctcttaagatgacccggcaagacctgacccgcacgcagatggaactcaacaacatgaaggccaactttggagatgtggtccccaggagggactttgaaatgcaggagaagaccaacaaggatcttcaggagcaggtgctggcaggcaggcagggccaggagggtaggacggggtctcacaggtggggggccagggccaatgtccttgcccacagctggacaccctgagagccagctacgaggaggttcgcaaggagcatgagatcctcatgcagctgcacatgagcacgctgaaggaacgggaccaattcttctctgagctgcaggagatccagcgcacttccacgccgcggcctgactggaccaagtgcaaaggtgagggcagccggcagggccccaggtcctgcttacatgtgggcccagactccagctccctctccccacatgcagatgtggtggctgggggcccagagcgctggcagatgctggctgagggcaagaacagcgaccagctggtggacgtgctcctggaagagattggttcggggctgctgcgggagaaagacttcttccctggtctgggctatggggaagccatccctgcttttcttcggtttgatggcctcgtggagaacaagaagccaagcaagaaggacgtggtcaacctcctcaaggatgcctggaaggaacgtcttgctgaggagcagaaagagacgttcccagatttcttcttcaatttcctgaagcccctgggtctccctgtgcaccatgcaccatccactgctcagcccagcacagaggagggcacctgggagtctggggcacggagaggaggggtcagggcctgtcactctctttcctgtggggcagccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcaggtgattgacatcaggcgtgtgggacctcgagagccagagcctgcaagctaggaacttgtgggcagcctgcgtactccagtcctgctaacccctagcttttaatataaaagtgtttgtctgaaaacaaaaaat

SEQ ID NO: 287196 - DNA, 2747 bp, Homo sapiens
agcgggtagtataaccgtcctcagccataagcctgtcccatcgagacgtcgggacaccgaaaactaccattcccgccggcaaagcggctccggcctctcagcacacttccctccccatggcctctgttcatccccctgcctcagttctggtacctggggtcaaatcggctgtagtggttgactctcagggcacccgctgccgggtcccagtccacctttgctactttgtcctactcccagcccgcgggcgctaggctcgggggcgtggcgcatccctgactccgcccccgccgcgggggggcctctggggcctggtcgccatggcgaccggctgtacgctaccacagcttcccaggccgcgggtgctgattgcccgcctgcccgtgggtcatggcctgccagcagtcgcggtaccacagcttctcgtccgcgtcgaggtaggcgctggcagggatgagggcagagatgagggtttgagtacttctagagagggaaatggcacttgatccggacctctgcacctcctgctggcctctgaccattgatctagggctccagcaccacagagtcaatggttagaatcgggctgatttagcccagtgaagacgttacgtgctagcaaaacgattacagccacggccttcaggagtgaccatagacgaatcctttctcacagaagacaagagcacccagaatcgcaagcttcttcagaaacgaaggacgctggagctgccagcagcacccctttcgcactgccaagccccagtacttggaggaactggaaaactacctacgcaaggagctcctcctgctggacctgggcacagattccacccaggaactaaggctgcagcccaccaaagggagaagattcgggctctggagcccctgaaggccaagcttgtcactgtgaatgaggactgcaatgagaggatcctggccatgagagctgaggagaaatatgaaatctccctgctcaagaaagagaagatgaacttgctaaaactcatcgacaaaaagaatgaggagaagatttcattgcagagcgaggtgaccaaactgaggaagaacttggctgaggagtacctgcactacctcagtgagcgagatgcctgtaagatcctcatcgcagacctgaatgagctgcggtaccagcgggaggacatgtcattagcccagtcgccaggcatctggggggaggaccctgtgaagttaaccctggctcttaagatgacccggcaagacctgacccgcacgcagatggaactcaacaacatgaaggccaactttggagatgtggtccccaggagggactttgaaatgcaggagaagaccaacaaggatcttcaggagcaggtgctggcaggcaggcagggccaggagggtaggacggggtctcacaggtggggggccagggccaatgtccttgcccacagctggacaccctgagagccagctacgaggaggttcgcaaggagcatgagatcctcatgcagctgcacatgagcacgctgaaggaacgggaccaattcttctctgagctgcaggagatccagcgcacttccacgccgcggcctgactggaccaagtgcaaaggtgagggcagccggcagggccccaggtcctgcttacatgtgggcccagactccagctccctctccccacatgcagatgtggtggctgggggcccagagcgctggcagatgctggctgagggcaagaacagcgaccagctggtggacgtgctcctggaagagattggttcggggctgctgcgggagaaagacttcttccctggtctgggctatggggaagccatccctgcttttcttcggtttgatggcctcgtggagaacaagaagccaagcaagaaggacgtggtcaacctcctcaaggatgcctggaaggaacgtcttgctgaggagcagaaagagacgttcccagatttcttcttcaatttcctggagcatcgctttgggcccagtgatgccatggcctgggcttatactatttttgaaaatatcaagatcttccactccaacgaggttatgagtcagttctatgcagtcttgatgggaaagcggagtgagaatgtgtatgtcacccagaaggagacagtagcccagctgctgaaggagatgacaaatgctgacagtcagaacgaggggctactaaccatggagcagttcaacactgtcctcaagagtaccttccctctcaagacagaagagcaaatccaggagctgatggaggcagggggctggcatcccagcagcagcaatgcagacttgctcaactaccgctcactgtttatggaggatgaggagggccagagtgagccctttgtgcaaaaactctgggaacaatacatggatgagaaggacgagtacttacagcagctaaagcaggagcttggcatagaactccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcaggtgattgacatcaggcgtgtgggacctcgagagccagagcctgcaagctaggaacttgtgggcagcctgcgtactccagtcctgctaacccctagcttttaatataaaagtgtttgtctgaaaacaaaaaat

SEQ ID NO: 287197 - DNA, 1169 bp, Homo sapiens
agcgggtagtataaccgtcctcagccataagcctgtcccatcgagacgtcgggacaccgaaaactaccattcccgccggcaaagcggctccggcctctcagcacacttccctccccatggcctctgttcatccccctgcctcagttctggtacctggggtcaaatcggctgtagtggttgactctcagggcacccgctgccgggtcccagtccacctttgctactttgtcctactcccagcccgcgggcgctaggctcgggggcgtggcgcatccctgactccgcccccgccgcgggggggcctctggggcctggtcgccatggcgaccggctgtacgctaccacagcttcccaggccgcgggtgctgattgcccgcctgcccgtgggtcatggcctgccagcagtcgcggtaccacagcttctcgtccgcgtcgaggtaggcgctggcagggatgagggcagagatgagggtttgagtacttctagagagggaaatggcacttgatccggacctctgcacctcctgctggcctctgaccattgatctagggctccagcaccacagagtcaatggttagaatcgggctgatttagcccagtgaagacgttacgtgctagcaaaacgattacagccacggccttcaggagtgaccatagacgaatcctttctcacagaagacaagagcatcccagcagcagcaatgcagacttgctcaactaccgctcactgtttatggaggatgaggagggccagagtgagccctttgtgcaaaaactctgggaacaatacatggatgagaaggacgagtacttacagcagctaaagcaggagcttggcatagaactccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcaggtgattgacatcaggcgtgtgggacctcgagagccagagcctgcaagctaggaacttgtgggcagcctgcgtactccagtcctgctaacccctagcttttaatataaaagtgtttgtctgaaaacaaaaaat

SEQ ID NO: 287198 - DNA, 2634 bp, Homo sapiens
agcgggtagtataaccgtcctcagccataagcctgtcccatcgagacgtcgggacaccgaaaactaccattcccgccggcaaagcggctccggcctctcagcacacttccctccccatggcctctgttcatccccctgcctcagttctggtacctggggtcaaatcggctgtagtggttgactctcagggcacccgctgccgggtcccagtccacctttgctactttgtcctactcccagcccgcgggcgctaggctcgggggcgtggcgcatccctgactccgcccccgccgcgggggggcctctggggcctggtcgccatggcgaccggctgtacgctaccacagcttcccaggccgcgggtgctgattgcccgcctgcccgtgggtcatggcctgccagcagtcgcggtaccacagcttctcgtccgcgtcgagattacagccacggccttcaggagtgaccatagacgaatcctttctcacagaagacaagagcacccagaatcgcaagcttcttcagaaacgaaggacgctgactggtcagttctccatgggtgggcacctgtccccatggcccacatacaccagtggccagaccattttgcaaaatcgaaaaccctgttcagatgactaccggaagcgagtagggagctgccagcagcacccctttcgcactgccaagccccagtacttggaggaactggaaaactacctacgcaaggagctcctcctgctggacctgggcacagattccacccaggaactaaggctgcagccttacagagagatctttgagttcttcatagaggacttcaaaacgtacaagccattactatcctccatcaagaatgcgtatgaggggatgctggcccaccaaagggagaagattcgggctctggagcccctgaaggccaagcttgtcactgtgaatgaggactgcaatgagaggatcctggccatgagagctgaggagaaatatgaaatctccctgctcaagaaagagaagatgaacttgctaaaactcatcgacaaaaagaatgaggagaagatttcattgcagagcgaggtgaccaaactgaggaagaacttggctgaggagtacctgcactacctcagtgagcgagatgcctgtaagatcctcatcgcagacctgaatgagctgcggtaccagcgggaggacatgtcattagcccagtcgccaggcatctggggggaggaccctgtgaagttaaccctggctcttaagatgacccggcaagacctgacccgcacgcagatggaactcaacaacatgaaggccaactttggagatgtggtccccaggagggactttgaaatgcaggagaagaccaacaaggatcttcaggagcaggtgctggcaggcaggcagggccaggagggtaggacggggtctcacaggtggggggccagggccaatgtccttgcccacagctggacaccctgagagccagctacgaggaggttcgcaaggagcatgagatcctcatgcagctgcacatgagcacgctgaaggaacgggaccaattcttctctgagctgcaggagatccagcgcacttccacgccgcggcctgactggaccaagtgcaaaggtgagggcagccggcagggccccaggtcctgcttacatgtgggcccagactccagctccctctccccacatgcagatgtggtggctgggggcccagagcgctggcagatgctggctgagggcaagaacagcgaccagctggtggacgtgctcctggaagagattggttcggggctgctgcgggagaaagacttcttccctggtctgggctatggggaagccatccctgcttttcttcggtttgatggcctcgtggagaacaagaagccaagcaagaaggacgtggtcaacctcctcaaggatgcctggaaggaacgtcttgctgaggagcagaaagagacgttcccagatttcttcttcaatttcctgaagcccctgggtctccctgtgcaccatgcaccatccactgctcagcccagcacagaggagggcacctgggagtctggggcacggagaggaggggtcagggcctgtcactctctttcctgtggggcagccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcagcggggagagctttccccaaaggccagcaggggaaaacccaaccttacttggaggagccagggaagtatctcgcagatcccgcaaaaaggcacccacgtctacagctcggcgggctggaggtctgcgggccaagccaggcctctgcactgactgtggctgaagaggtgtggcaaaggtcaggttgagggatctggtgagggaagaggcatcagcattcccttgaggctcttgggagagagacagcccctggtccactccctgctgaaacactgacagtctcagcctctgtttcctcctgccaggggccagcagacctggagccagggttgtggggg

SEQ ID NO: 287199 - DNA, 491 bp, Homo sapiens
gtgaatggaagtggtgtgatgatgaccaagtccccgaattcctgccaactccacgacaagggtgaccccctaccctgctctgcctttctacggagagtgacacactgagccaccaccttcccccagagccttgctaactccaccctctgccctgctgctaggctcagtactttccccacagggggaaacattggcaccttgccgaattctcagaaatggccaatctccttcttctttcacctttcctgttcacagtccctgatggggccccccagaacccagcccactccctggggtgaccagctgcatacaggggtccaggggcagcccctgaccacacagccaccttcttgccaggtgaccaaactgaggaagaacttggctgaggagtacctgcactacctcagtgagcgagatgcctgtaagatcctcatcgcagacctgaatgagctgcggtaccagcgggaggacatgtcattagcccagtcgcc

SEQ ID NO: 287200 - DNA, 2483 bp, Homo sapiens
agcgggtagtataaccgtcctcagccataagcctgtcccatcgagacgtcgggacaccgaaaactaccattcccgccggcaaagcggctccggcctctcagcacacttccctccccatggcctctgttcatccccctgcctcagttctggtacctggggtcaaatcggctgtagtggttgactctcagggcacccgctgccgggtcccagtccacctttgctactttgtcctactcccagcccgcgggcgctaggctcgggggcgtggcgcatccctgactccgcccccgccgcgggggggcctctggggcctggtcgccatggcgaccggctgtacgctaccacagcttcccaggccgcgggtgctgattgcccgcctgcccgtgggtcatggcctgccagcagtcgcggtaccacagcttctcgtccgcgtcgagattacagccacggccttcaggagtgaccatagacgaatcctttctcacagaagacaagagcacccagaatcgcaagcttcttcagaaacgaaggacgctggagctgccagcagcacccctttcgcactgccaagccccagtacttggaggaactggaaaactacctacgcaaggagctcctcctgctggacctgggcacagattccacccaggaactaaggctgcagcccaccaaagggagaagattcgggctctggagcccctgaaggccaagcttgtcactgtgaatgaggactgcaatgagaggatcctggccatgagagctgaggagaaatatgaaatctccctgctcaagaaagagaagatgaacttgctaaaactcatcgacaaaaagaatgaggagaagatttcattgcagagcgaggtgaccaaactgaggaagaacttggctgaggagtacctgcactacctcagtgagcgagatgcctgtaagatcctcatcgcagacctgaatgagctgcggtaccagcgggaggacatgtcattagcccagtcgccaggcatctggggggaggaccctgtgaagttaaccctggctcttaagatgacccggcaagacctgacccgcacgcagatggaactcaacaacatgaaggccaactttggagatgtggtccccaggagggactttgaaatgcaggagaagaccaacaaggatcttcaggagcaggtgctggcaggcaggcagggccaggagggtaggacggggtctcacaggtggggggccagggccaatgtccttgcccacagctggacaccctgagagccagctacgaggaggttcgcaaggagcatgagatcctcatgcagctgcacatgagcacgctgaaggaacgggaccaattcttctctgagctgcaggagatccagcgcacttccacgccgcggcctgactggaccaagtgcaaagatgtggtggctgggggcccagagcgctggcagatgctggctgagggcaagaacagcgaccagctggtggacgtgctcctggaagagattggttcggggctgctgcgggagaaagacttcttccctggtctgggctatggggaagccatccctgcttttcttcggtttgatggcctcgtggagaacaagaagccaagcaagaaggacgtggtcaacctcctcaaggatgcctggaaggaacgtcttgctgaggagcagaaagagacgttcccagatttcttcttcaatttcctggagcatcgctttgggcccagtgatgccatggcctgggcttatactatttttgaaaatatcaagatcttccactccaacgaggttatgagtcagttctatgcagtcttgatgggaaagcggagtgagaatgtgtatgtcacccagaaggagacagtagcccagctgctgaaggagatgacaaatgctgacagtcagaacgaggggctactaaccatggagcagttcaacactgtcctcaagagtaccttccctctcaagacagaagagcaaatccaggagctgatggaggcagggggctggcatcccagcagcagcaatgcagacttgctcaactaccgctcactgtttatggaggatgaggagggccagagtgagccctttgtgcaaaaactctgggaacaatacatggatgagaaggacgagtacttacagcagctaaagcaggagcttggcatagaactccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcaggtgattgacatcaggcgtgtgggacctcgagagccagagcctgcaagctaggaacttgtgggcagcctgcgtactccagtcctgctaacccctagcttttaatataaaagtgtttgtctgaaaacaaaaaat

SEQ ID NO: 287201 - DNA, 386 bp, Homo sapiens
cgagagggaggagagcttggcaactcgccccaactacggacccaggccctgtgaggctgggtcacggggtggacctgcttcagctgggccccttggggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcaggtgattgacatcaggcgtgtgggacctcgagagccagagcctgcaagctaggaacttgtgggcagcctgcgtactccagtcctgctaacccctagcttttaatataaaagtgtttgtctgaaaacaaaaaat

SEQ ID NO: 287202 - DNA, 2234 bp, Homo sapiens
agcgggtagtataaccgtcctcagccataagcctgtcccatcgagacgtcgggacaccgaaaactaccattcccgccggcaaagcggctccggcctctcagcacacttccctccccatggcctctgttcatccccctgcctcagttctggtacctggggtcaaatcggctgtagtggttgactctcagggcacccgctgccgggtcccagtccacctttgctactttgtcctactcccagcccgcgggcgctaggctcgggggcgtggcgcatccctgactccgcccccgccgcgggggggcctctggggcctggtcgccatggcgaccggctgtacgctaccacagcttcccaggccgcgggtgctgattgcccgcctgcccgtgggtcatggcctgccagcagtcgcggtaccacagcttctcgtccgcgtcgagattacagccacggccttcaggagtgaccatagacgaatcctttctcacagaagacaagagcacccagaatcgcaagcttcttcagaaacgaaggacgctggtgaccaaactgaggaagaacttggctgaggagtacctgcactacctcagtgagcgagatgcctgtaagatcctcatcgcagacctgaatgagctgcggtaccagcgggaggacatgtcattagcccagtcgccaggcatctggggggaggaccctgtgaagttaaccctggctcttaagatgacccggcaagacctgacccgcacgcagatggaactcaacaacatgaaggccaactttggagatgtggtccccaggagggactttgaaatgcaggagaagaccaacaaggatcttcaggagcaggtgctggcaggcaggcagggccaggagggtaggacggggtctcacaggtggggggccagggccaatgtccttgcccacagctggacaccctgagagccagctacgaggaggttcgcaaggagcatgagatcctcatgcagctgcacatgagcacgctgaaggaacgggaccaattcttctctgagctgcaggagatccagcgcacttccacgccgcggcctgactggaccaagtgcaaaggtgagggcagccggcagggccccaggtcctgcttacatgtgggcccagactccagctccctctccccacatgcagatgtggtggctgggggcccagagcgctggcagatgctggctgagggcaagaacagcgaccagctggtggacgtgctcctggaagagattggttcggggctgctgcgggagaaagacttcttccctggtctgggctatggggaagccatccctgcttttcttcggtttgatggcctcgtggagaacaagaagccaagcaagaaggacgtggtcaacctcctcaaggatgcctggaaggaacgtcttgctgaggagcagaaagagacgttcccagatttcttcttcaatttcctggagcatcgctttgggcccagtgatgccatggcctgggcttatactatttttgaaaatatcaagatcttccactccaacgaggttatgagtcagttctatgcagtcttgatgggaaagcggagtgagaatgtgtatgtcacccagaaggagacagtagcccagctgctgaaggagatgacaaatgctgacagtcagaacgaggggctactaaccatggagcagttcaacactgtcctcaagagtaccttccctctcaagacagaagagcaaatccaggagctgatggaggcagggggctggcatcccagcagcagcaatgcagacttgctcaactaccgctcactgtttatggaggatgaggagggccagagtgagccctttgtgcaaaaactctgggaacaatacatggatgagaaggacgagtacttacagcagctaaagcaggagcttggcatagaactccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcaggtgattgacatcaggcgtgtgggacctcgagagccagagcctgcaagctaggaacttgtgggcagcctgcgtactccagtcctgctaacccctagcttttaatataaaagtgtttgtctgaaaacaaaaaat

SEQ ID NO: 287203 - DNA, 2431 bp, Homo sapiens
agcgggtagtataaccgtcctcagccataagcctgtcccatcgagacgtcgggacaccgaaaactaccattcccgccggcaaagcggctccggcctctcagcacacttccctccccatggcctctgttcatccccctgcctcagttctggtacctggggtcaaatcggctgtagtggttgactctcagggcacccgctgccgggtcccagtccacctttgctactttgtcctactcccagcccgcgggcgctaggctcgggggcgtggcgcatccctgactccgcccccgccgcgggggggcctctggggcctggtcgccatggcgaccggctgtacgctaccacagcttcccaggccgcgggtgctgattgcccgcctgcccgtgggtcatggcctgccagcagtcgcggtaccacagcttctcgtccgcgtcgagattacagccacggccttcaggagtgaccatagacgaatcctttctcacagaagacaagagcacccagaatcgcaagcttcttcagaaacgaaggacgctgcccaccaaagggagaagattcgggctctggagcccctgaaggccaagcttgtcactgtgaatgaggactgcaatgagaggatcctggccatgagagctgaggagaaatatgaaatctccctgctcaagaaagagaagatgaacttgctaaaactcatcgacaaaaagaatgaggagaagatttcattgcagagcgaggtgaccaaactgaggaagaacttggctgaggagtacctgcactacctcagtgagcgagatgcctgtaagatcctcatcgcagacctgaatgagctgcggtaccagcgggaggacatgtcattagcccagtcgccaggcatctggggggaggaccctgtgaagttaaccctggctcttaagatgacccggcaagacctgacccgcacgcagatggaactcaacaacatgaaggccaactttggagatgtggtccccaggagggactttgaaatgcaggagaagaccaacaaggatcttcaggagcaggtgctggcaggcaggcagggccaggagggtaggacggggtctcacaggtggggggccagggccaatgtccttgcccacagctggacaccctgagagccagctacgaggaggttcgcaaggagcatgagatcctcatgcagctgcacatgagcacgctgaaggaacgggaccaattcttctctgagctgcaggagatccagcgcacttccacgccgcggcctgactggaccaagtgcaaaggtgagggcagccggcagggccccaggtcctgcttacatgtgggcccagactccagctccctctccccacatgcagatgtggtggctgggggcccagagcgctggcagatgctggctgagggcaagaacagcgaccagctggtggacgtgctcctggaagagattggttcggggctgctgcgggagaaagacttcttccctggtctgggctatggggaagccatccctgcttttcttcggtttgatggcctcgtggagaacaagaagccaagcaagaaggacgtggtcaacctcctcaaggatgcctggaaggaacgtcttgctgaggagcagaaagagacgttcccagatttcttcttcaatttcctggagcatcgctttgggcccagtgatgccatggcctgggcttatactatttttgaaaatatcaagatcttccactccaacgaggttatgagtcagttctatgcagtcttgatgggaaagcggagtgagaatgtgtatgtcacccagaaggagacagtagcccagctgctgaaggagatgacaaatgctgacagtcagaacgaggggctactaaccatggagcagttcaacactgtcctcaagagtaccttccctctcaagacagaagagcaaatccaggagctgatggaggcagggggctggcatcccagcagcagcaatgcagacttgctcaactaccgctcactgtttatggaggatgaggagggccagagtgagccctttgtgcaaaaactctgggaacaatacatggatgagaaggacgagtacttacagcagctaaagcaggagcttggcatagaactccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcaggtgattgacatcaggcgtgtgggacctcgagagccagagcctgcaagctaggaacttgtgggcagcctgcgtactccagtcctgctaacccctagcttttaatataaaagtgtttgtctgaaaacaaaaaat

SEQ ID NO: 287204 - DNA, 3229 bp, Homo sapiens
agcgggtagtataaccgtcctcagccataagcctgtcccatcgagacgtcgggacaccgaaaactaccattcccgccggcaaagcggctccggcctctcagcacacttccctccccatggcctctgttcatccccctgcctcagttctggtacctggggtcaaatcggctgtagtggttgactctcagggcacccgctgccgggtcccagtccacctttgctactttgtcctactcccagcccgcgggcgctaggctcgggggcgtggcgcatccctgactccgcccccgccgcgggggggcctctggggcctggtcgccatggcgaccggctgtacgctaccacagcttcccaggccgcgggtgctgattgcccgcctgcccgtgggtcatggcctgccagcagtcgcggtaccacagcttctcgtccgcgtcgagattacagccacggccttcaggagtgaccatagacgaatcctttctcacagaagacaagagcacccagaatcgcaagcttcttcagaaacgaaggacgctgactggtcagttctccatgggtgggcacctgtccccatggcccacatacaccagtggccagaccattttgcaaaatcgaaaaccctgttcagatgactaccggaagcgagtagggagctgccagcagcacccctttcgcactgccaagccccagtacttggaggaactggaaaactacctacgcaaggagctcctcctgctggacctgggcacagattccacccaggaactaaggctgcagccttacagagagatctttgagttcttcatagaggacttcaaaacgtacaagccattactatcctccatcaagaatgcgtatgaggggatgctggcccaccaaagggagaagattcgggctctggagcccctgaaggccaagcttgtcactgtgaatgaggactgcaatgagaggatcctggccatgagagctgaggagaaatatgaaatctccctgctcaagaaagagaagatgaacttgctaaaactcatcgacaaaaagaatgaggagaagatttcattgcagagcgaggtgaccaaactgaggaagaacttggctgaggagtacctgcactacctcagtgagcgagatgcctgtaagatcctcatcgcagacctgaatgagctgcggtaccagcgggaggacatgtcattagcccagtcgccaggcatctggggggaggaccctgtgaagttaaccctggctcttaagatgacccggcaagacctgacccgcacgcagatggaactcaacaacatgaaggccaactttggagatgtggtccccaggagggactttgaaatgcaggagaagaccaacaaggatcttcaggagcaggtgctggcaggcaggcagggccaggagggtaggacggggtctcacaggtggggggccagggccaatgtccttgcccacagctggacaccctgagagccagctacgaggaggttcgcaaggagcatgagatcctcatgcagctgcacatgagcacgctgaaggaacgggaccaattcttctctgagctgcaggagatccagcgcacttccacgccgcggcctgactggaccaagtgcaaaggtgagggcagccggcagggccccaggtcctgcttacatgtgggcccagactccagctccctctccccacatgcagatgtggtggctgggggcccagagcgctggcagatgctggctgagggcaagaacagcgaccagctggtggacgtgctcctggaagagattggttcggggctgctgcgggagaaagacttcttccctggtctgggctatggggaagccatccctgcttttcttcggtttgatggcctcgtggagaacaagaagccaagcaagaaggacgtggtcaacctcctcaaggatgcctggaaggaacgtcttgctgaggagcagaaagagacgttcccagatttcttcttcaatttcctggagcatcgctttgggcccagtgatgccatggcctgggcttatactatttttgaaaatatcaagatcttccactccaacgaggttatgagtcagttctatgcagtcttgatgggaaagcggagtgagaatgtgtatgtcacccagaaggagacagtagcccagctgctgaaggagatgacaaatgctgacagtcagaacgaggggctactaaccatggagcagttcaacactgtcctcaagagtaccttccctctcaagacagaagagcaaatccaggagctgatggaggcagggggctggcatcccagcagcagcaatgcagacttgctcaactaccgctcactgtttatggaggatgaggagggccagagtgagccctttgtgcaaaaactctgggaacaatacatggatgagaaggacgagtacttacagcagctaaagcaggagcttggcatagaactccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcagcggggagagctttccccaaaggccagcaggggaaaacccaaccttacttggaggagccagggaagtatctcgcagatcccgcaaaaaggcacccacgtctacagctcggcgggctggaggtctgcgggccaagccaggcctctgcactgactgtggctgaagaggtgtggcaaaggtcaggttgagggatctggtgaggtggggaggcacagaggaaagtcaggtacctgagacccagtttgcccacagatccctccatctgccctggggctctcatctcttagaacagatgctgtgaggctaaaactggtaggaagtagtatgggcagattccatcccaggcagcacctccctccccaagtctctcctccacccactcccagaacaggaaacacccagagcagcacctggtgagggaagaggcatcagcattcccttgaggctctgtcagcaaccggcaagagaatgtaaaagaagaaaaccatgggttggaccgcctgcggtgctggcactggcttcactaccgactcaggcatcaggatggaagattctggggctgcagaaacaccaaggagagggtggggctgacagaacag

SEQ ID NO: 287205 - DNA, 1382 bp, Homo sapiens
  misc_feature (1382)..(1382): n is a, c, g, or t
aggccgctagggtgcggggttggggaggaggccgctagtctacgcctgtggagccgatactcagccctctgcgaccatggctgtgctggcggcacttctgcgcagcggcgcccgcagccgcagccccctgctccggaggctggtgcaggaaataagatatgtggaacggagttatgtatcaaaacccactttgaaggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcagatcaagcaagagacaggctccttagcaaaaatatgctgtcatgtcaggaggtgagacctggacacacagaagaatcaagattctctcagatctgagcccttcatttttcagatgaagatttttttcagtgtgtctgagacagccacagagttacagggctgagcatctgccatgtgacagtcattggaaatagagtggtgaacaaaacatttaaaaaaatctgtacatgtgcaggtctctgttggaaaaatgcctaaaagaaatgctgagtcaggatttgaacattttggtatttgcaaatgctttccataaaagttgtaccagttagactttccaaaaattgtgtgacttgtctggatctgcaccaccactgggtggtaccaaacccttgtcaaactggtaggtgaaaaacggtcaccagatttagtttcagaactgtttgtcatggaaagttttgtcttaattgaagtattgtggttctctagcaaatgccatttgtactatattgaaatactttcatttaatattattttattcatttgtggatatatacagtgacttataggcattcttggaagtgctttgttttgaatatttatgaccttagaaaacagtcagttttactttataatgaagaattgataccttattttctgtcacttattattgccatcacccccagtaaaaagtacaagtgaataaaacttagatgagaactgattaagaatttctctatttcggaataggcaaaatatttatgtttctttggtatagagcttgcttgtctgtatgcctgattaaagactgtaagaagatattattggctttatgtttacattaatgttttatattaaactgtttttaactagcn

SEQ ID NO: 287206 - DNA, 2579 bp, Homo sapiens
aggccgctagggtgcggggttggggaggaggccgctagtctacgcctgtggagccgatactcagccctctgcgaccatggctgtgctggcggcacttctgcgcagcggcgcccgcagccgcagccccctgctccggaggctggtgcaggaaataagatatgtggaacggagttatgtatcaaaacccactttgaaggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcaggatgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatgggcagctgtgctgagaatacagcaaagaagctgaatattgcacgaaatgaacaggacgcttatgctattaattcttataccagaagtaaagcagcatgggaagctgggaaatttggaaatgaagttattcctgtcacagttacagtaaaaggtcaaccagatgtagtggtgaaagaagatgaagaatataaacgtgttgattttagcaaagttccaaagctgaagacagttttccagaaagaaaatggcacagtaacagctgccaatgccagtacactgaatgatggagcagctgctctggttctcatgacggcagatgcagcgaagaggctcaatgttacaccactggcaagaatagtagcatttgctgacgctgctgtagaacctattgattttccaattgctcctgtatatgctgcatctatggttcttaaagatgtgggattgaaaaaagaagatattgcaatgtgggaagtaaatgaagcctttagtctggttgtactagcaaacattaaaatgttggagattgatccccaaaaagtgaatatcaatggaggagctgtttctctgggacatccaattgggatgtctggagccaggattgttggtcatttgactcatgccttgaagcaaggagaatacggtcttgccagtatttgcaatggaggaggaggtgcttctgccatgctaattcagaagctgtagacaacctctgctatttaaggagacaaccctatgtgaccagaaggcctgctgtaatcagtgtgactactgtgggtcagcttatattcagataagctgtttcattttttattattttctatgttaacttttaaaaatcaaaatgatgaaatcccaaaacattttgaaattaaaaataaatttcttcttctgcttttttcttggtaaccttgaaaagtttgatacatttttgcattctgagtctatacttatcgaaatatggtagaaataccaatgtgtaatattagtgacttacataagtagctagaagtttccatttgtgagaacacatttatatttttgaggattgttaaaggtcaagtgaatgctctttataggtaatttacatttagtaaattacggtaaattaaattacttctctttacagtaagagttggctattctggacaaactagcagtgcttcatataatcactcaaaccacagtgtgtgcagcagtactagaaacaagacagaagcccatgtcctcagggtctagagtgggggcaatttcttataacctcaacattcagggttgggggaggtcaagcagaaaaccctggagtttgggctctgaattactatagcagcatagagagtgggaagggaggtagaaactgatatgctgaatggatatataaaaaagggaacagatcaccacttccaatacacgacaatgcctgttcttaagcaggacagactgtaacagaagtatctcgcattgcattttatctgggaaaaaattaattaaaacgctacaggcaggggctatgcacactaccctcaattgcagctctgaagagggaaaactccccctcaggaagaggagggggcagtaaaggtcattgtgtacacattatctgttggcaaataatgtattgtagatcttttgaaggagcaaaatgacaatatatgggagaaatagattagattgctcttcagattcagaggaagagtagagtattttcaaaaacatctgtaatcatcaccaacttttgaggcttgttatgtgctttatatgtataaactcatttaattgtcacaaaaacttctaagagtgggtaccattattatccctcctttataaacaaggaaattgaggcatagagtagctaaataaattccaagggcaaaaagctggctaggattcaactccaagttagtcaagctccagagcccacgtt

SEQ ID NO: 287207 - DNA, 3116 bp, Homo sapiens
agtcacgcgacgggttctggtccaaaaaccgcctaagtgctccgataacacccagggactcgcctatttttacagcgcgtttctacttccaaggtctcggcgtaatcatcttaatgagcgttactggtggggggaatcagatcctgtttgtatgcttatggaattatccagaagtaaaaggggtgaatgatgtagaggagaaggaagggataactgtgccatctttgaaaaggcaactggaaatgggatccagagtaaagtggagagaaccagggaagattccattaaactggaccagaagcttgaaagaagagaagtggcttagtaaacaaggaacaaactagctaagtagaaaggggacttttaaaatttaatttttatttcaataggcttttgggaacaggtggtgttggattatatgaataagttctttattggtggtatctgatattttggtgcacccatcacctgagcagtatacactgtaaaccaatgtgtagtcttttattcctcacccccaccccccgcctttcccctgagtccccaaagtccactgtatcattcttatgcctttgtgtcctcatagcgcagctcccacttatgagtgagaacataagctgtttggtgtttccattcctgagttacttcacttagaataatagtctccaattccatccaggttgcagaaataagatatgtggaacggagttatgtatcaaaacccactttgaaggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcaggatgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatgggcagctgtgctgagaatacagcaaagaagctgaatattgcacgaaatgaacaggacgcttatgctattaattcttataccagaagtaaagcagcatgggaagctgggaaatttggaaatgaagttattcctgtcacagttacagtaaaaggtcaaccagatgtagtggtgaaagaagatgaagaatataaacgtgttgattttagcaaagttccaaagctgaagacagttttccagaaagaaaatggcacagtaacagctgccaatgccagtacactgaatgatggagcagctgctctggttctcatgacggcagatgcagcgaagaggctcaatgttacaccactggcaagaatagtagcatttgctgacgctgctgtagaacctattgattttccaattgctcctgtatatgctgcatctatggttcttaaagatgtgggattgaaaaaagaagatattgcaatgtgggaagtaaatgaagcctttagtctggttgtactagcaaacattaaaatgttggagattgatccccaaaaagtgaatatcaatggaggagctgtttctctgggacatccaattgggatgtctggagccaggattgttggtcatttgactcatgccttgaagcaaggagaatacggtcttgccagtatttgcaatggaggaggaggtgcttctgccatgctaattcagaagctgtagacaacctctgctatttaaggagacaaccctatgtgaccagaaggcctgctgtaatcagtgtgactactgtgggtcagcttatattcagataagctgtttcattttttattattttctatgttaacttttaaaaatcaaaatgatgaaatcccaaaacattttgaaattaaaaataaatttcttcttctgcttttttcttggtaaccttgaaaagtttgatacatttttgcattctgagtctatacttatcgaaatatggtagaaataccaatgtgtaatattagtgacttacataagtagctagaagtttccatttgtgagaacacatttatatttttgaggattgttaaaggtcaagtgaatgctctttataggtaatttacatttagtaaattacggtaaattaaattacttctctttacagtaagagttggctattctggacaaactagcagtgcttcatataatcactcaaaccacagtgtgtgcagcagtactagaaacaagacagaagcccatgtcctcagggtctagagtgggggcaatttcttataacctcaacattcagggttgggggaggtcaagcagaaaaccctggagtttgggctctgaattactatagcagcatagagagtgggaagggaggtagaaactgatatgctgaatggatatataaaaaagggaacagatcaccacttccaatacacgacaatgcctgttcttaagcaggacagactgtaacagaagtatctcgcattgcattttatctgggaaaaaattaattaaaacgctacaggcaggggctatgcacactaccctcaattgcagctctgaagagggaaaactccccctcaggaagaggagggggcagtaaaggtcattgtgtacacattatctgttggcaaataatgtattgtagatcttttgaaggagcaaaatgacaatatatgggagaaatagattagattgctcttcagattcagaggaagagtagagtattttcaaaaacatctgtaatcatcaccaacttttgaggcttgttatgtgctttatatgtataaactcatttaattgtcacaaaaacttctaagagtgggtaccattattatccctcctttataaacaaggaaattgaggcatagagtagctaaataaattccaagggcaaaaagctggctaggattcaactccaagttagtcaagctccagagcccacgtt

SEQ ID NO: 287208 - DNA, 2418 bp, Homo sapiens
gctgcagccgcagtgactctagaggtccccaagctgaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcaggatgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatgggcagctgtgctgagaatacagcaaagaagctgaatattgcacgaaatgaacaggacgcttatgctattaattcttataccagaagtaaagcagcatgggaagctgggaaatttggaaatgaagttattcctgtcacagttacagtaaaaggtcaaccagatgtagtggtgaaagaagatgaagaatataaacgtgttgattttagcaaagttccaaagctgaagacagttttccagaaagaaaatggcacagtaacagctgccaatgccagtacactgaatgatggagcagctgctctggttctcatgacggcagatgcagcgaagaggctcaatgttacaccactggcaagaatagtagcatttgctgacgctgctgtagaacctattgattttccaattgctcctgtatatgctgcatctatggttcttaaagatgtgggattgaaaaaagaagatattgcaatgtgggaagtaaatgaagcctttagtctggttgtactagcaaacattaaaatgttggagattgatccccaaaaagtgaatatcaatggaggagctgtttctctgggacatccaattgggatgtctggagccaggattgttggtcatttgactcatgccttgaagcaaggagaatacggtcttgccagtatttgcaatggaggaggaggtgcttctgccatgctaattcagaagctgtagacaacctctgctatttaaggagacaaccctatgtgaccagaaggcctgctgtaatcagtgtgactactgtgggtcagcttatattcagataagctgtttcattttttattattttctatgttaacttttaaaaatcaaaatgatgaaatcccaaaacattttgaaattaaaaataaatttcttcttctgcttttttcttggtaaccttgaaaagtttgatacatttttgcattctgagtctatacttatcgaaatatggtagaaataccaatgtgtaatattagtgacttacataagtagctagaagtttccatttgtgagaacacatttatatttttgaggattgttaaaggtcaagtgaatgctctttataggtaatttacatttagtaaattacggtaaattaaattacttctctttacagtaagagttggctattctggacaaactagcagtgcttcatataatcactcaaaccacagtgtgtgcagcagtactagaaacaagacagaagcccatgtcctcagggtctagagtgggggcaatttcttataacctcaacattcagggttgggggaggtcaagcagaaaaccctggagtttgggctctgaattactatagcagcatagagagtgggaagggaggtagaaactgatatgctgaatggatatataaaaaagggaacagatcaccacttccaatacacgacaatgcctgttcttaagcaggacagactgtaacagaagtatctcgcattgcattttatctgggaaaaaattaattaaaacgctacaggcaggggctatgcacactaccctcaattgcagctctgaagagggaaaactccccctcaggaagaggagggggcagtaaaggtcattgtgtacacattatctgttggcaaataatgtattgtagatcttttgaaggagcaaaatgacaatatatgggagaaatagattagattgctcttcagattcagaggaagagtagagtattttcaaaaacatctgtaatcatcaccaacttttgaggcttgttatgtgctttatatgtataaactcatttaattgtcacaaaaacttctaagagtgggtaccattattatccctcctttataaacaaggaaattgaggcatagagtagctaaataaattccaagggcaaaaagctggctaggattcaactccaagttagtcaagctccagagcccacgtt

SEQ ID NO: 287209 - DNA, 1579 bp, Homo sapiens
ctgtagtatttcaaggaaatgatgacagtaagttgtgattgctaattatttgaacatcatctgtcttttaaaaaatttaaggttcttaaagatgtgggattgaaaaaagaagatattgcaatgtgggaagtaaatgaagcctttagtctggttgtactagcaaacattaaaatgttggagattgatccccaaaaagtgaatatcaatggaggagctgtttctctgggacatccaattgggatgtctggagccaggattgttggtcatttgactcatgccttgaagcaaggagaatacggtcttgccagtatttgcaatggaggaggaggtgcttctgccatgctaattcagaagctgtagacaacctctgctatttaaggagacaaccctatgtgaccagaaggcctgctgtaatcagtgtgactactgtgggtcagcttatattcagataagctgtttcattttttattattttctatgttaacttttaaaaatcaaaatgatgaaatcccaaaacattttgaaattaaaaataaatttcttcttctgcttttttcttggtaaccttgaaaagtttgatacatttttgcattctgagtctatacttatcgaaatatggtagaaataccaatgtgtaatattagtgacttacataagtagctagaagtttccatttgtgagaacacatttatatttttgaggattgttaaaggtcaagtgaatgctctttataggtaatttacatttagtaaattacggtaaattaaattacttctctttacagtaagagttggctattctggacaaactagcagtgcttcatataatcactcaaaccacagtgtgtgcagcagtactagaaacaagacagaagcccatgtcctcagggtctagagtgggggcaatttcttataacctcaacattcagggttgggggaggtcaagcagaaaaccctggagtttgggctctgaattactatagcagcatagagagtgggaagggaggtagaaactgatatgctgaatggatatataaaaaagggaacagatcaccacttccaatacacgacaatgcctgttcttaagcaggacagactgtaacagaagtatctcgcattgcattttatctgggaaaaaattaattaaaacgctacaggcaggggctatgcacactaccctcaattgcagctctgaagagggaaaactccccctcaggaagaggagggggcagtaaaggtcattgtgtacacattatctgttggcaaataatgtattgtagatcttttgaaggagcaaaatgacaatatatgggagaaatagattagattgctcttcagattcagaggaagagtagagtattttcaaaaacatctgtaatcatcaccaacttttgaggcttgttatgtgctttatatgtataaactcatttaattgtcacaaaaacttctaagagtgggtaccattattatccctcctttataaacaaggaaattgaggcatagagtagctaaataaattccaagggcaaaaagctggctaggattcaactccaagttagtcaagctccagagcccacgtt

SEQ ID NO: 287210 - DNA, 1512 bp, Homo sapiens
aggccgctagggtgcggggttggggaggaggccgctagtctacgcctgtggagccgatactcagccctctgcgaccatggctgtgctggcggcacttctgcgcagcggcgcccgcagccgcagccccctgctccggaggctggtgcaggaaataagatatgtggaacggagttatgtatcaaaacccactttgaaggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcaggatgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatgggcagctgtgctgagaatacagcaaagaagctgaatattgcacgaaatgaacaggacgcttatgctattaattcttataccagaagtaaagcagcatgggaagctgggaaatttggaaatgaagttattcctgtcacagttacagtaaaaggtcaaccagatgtagtggtgaaagaagatgaagaatataaacgtgttgattttagcaaagttccaaagctgaagacagttttccagaaagaaaatggcacagtaacagctgccaatgccagtacactgaatgatggagcagctgctctggttctcatgacggcagatgcagcgaagaggctcaatgttacaccactggcaagaatagtagcatttgctgacgctgctgtagaacctattgattttccaattgctcctgtatatgctgcatctatggttcttaaagatgtgggattgaaaaaagaagatattgcaatgtgggaagtaaatgaagcctttagtctggttgtactagcaaacattaaaatgttggagattgatccccaaaaagtgaatatcaatggaggagctgtttctctgggacatccaattgggatgtctggagccaggattctgcagctgctttgccatttctcttcctaaattcattgtggttggcaattcccttttccctttccgcaaattagggtggaatcttaaataacctttccagcaattatttttccaaaattgagatactatttgtaaaaaatgtccttaaaatataaaaaacagacaaaaaagcaacaatacaactaaacaaaaaaaataaatagcaaccacgcacaaaacattcaatacgaagctacaacaaagcatacagaaaa

SEQ ID NO: 287211 - DNA, 1320 bp, Homo sapiens
gaagtcgccggtcaccgttggggaagcaaggagaatacggtcttgccagtatttgcaatggaggaggaggtgcttctgccatgctaattcagaagctgtagacaacctctgctatttaaggagacaaccctatgtgaccagaaggcctgctgtaatcagtgtgactactgtgggtcagcttatattcagataagctgtttcattttttattattttctatgttaacttttaaaaatcaaaatgatgaaatcccaaaacattttgaaattaaaaataaatttcttcttctgcttttttcttggtaaccttgaaaagtttgatacatttttgcattctgagtctatacttatcgaaatatggtagaaataccaatgtgtaatattagtgacttacataagtagctagaagtttccatttgtgagaacacatttatatttttgaggattgttaaaggtcaagtgaatgctctttataggtaatttacatttagtaaattacggtaaattaaattacttctctttacagtaagagttggctattctggacaaactagcagtgcttcatataatcactcaaaccacagtgtgtgcagcagtactagaaacaagacagaagcccatgtcctcagggtctagagtgggggcaatttcttataacctcaacattcagggttgggggaggtcaagcagaaaaccctggagtttgggctctgaattactatagcagcatagagagtgggaagggaggtagaaactgatatgctgaatggatatataaaaaagggaacagatcaccacttccaatacacgacaatgcctgttcttaagcaggacagactgtaacagaagtatctcgcattgcattttatctgggaaaaaattaattaaaacgctacaggcaggggctatgcacactaccctcaattgcagctctgaagagggaaaactccccctcaggaagaggagggggcagtaaaggtcattgtgtacacattatctgttggcaaataatgtattgtagatcttttgaaggagcaaaatgacaatatatgggagaaatagattagattgctcttcagattcagaggaagagtagagtattttcaaaaacatctgtaatcatcaccaacttttgaggcttgttatgtgctttatatgtataaactcatttaattgtcacaaaaacttctaagagtgggtaccattattatccctcctttataaacaaggaaattgaggcatagagtagctaaataaattccaagggcaaaaagctggctaggattcaactccaagttagtcaagctccagagcccacgtt

SEQ ID NO: 287212 - DNA, 1315 bp, Homo sapiens
agtcacgcgacgggttctggtccaaaaaccgcctaagtgctccgataacacccagggactcgcctatttttacagcgcgtttctacttccaaggtctcggcgtaatcatcttaatgagcgttactggtggggggaatcagatcctgtttgtatgcttatggaattatccagaagtaaaaggggtgaatgatgtagaggagaaggaagggataactgtgccatctttgaaaaggcaactggaaatgggatccagagtaaagtggagagaaccagggaagattccattaaactggaccagaagcttgaaagaagagaagtggcttagtaaacaaggaacaaactagctaagtagaaaggggacttttaaaatttaatttttatttcaataggcttttgggaacaggtggtgttggattatatgaataagttctttattggtggtatctgatattttggtgcacccatcacctgagcagtatacactgtaaaccaatgtgtagtcttttattcctcacccccaccccccgcctttcccctgagtccccaaagtccactgtatcattcttatgcctttgtgtcctcatagcgcagctcccacttatgagtgagaacataagctgtttggtgtttccattcctgagttacttcacttagaataatagtctccaattccatccaggttgcagaaataagatatgtggaacggagttatgtatcaaaacccactttgaaggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcaggatgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatggtaaatgtgatttttagtggataaatgctatctaatgtccaatactgtttgatttttcttactctatgtactttacaaactgaactgaaagatgggctctataaatgttgattttagccgtgt

SEQ ID NO: 287213 - DNA, 363 bp, Homo sapiens
aggcatttgggtctttctctgaggctgggtgactaaaaattcataaatactgtatttgccagaataagacaggttttcattataaaggagaacacggtgcttaaccctgggaatcaaatcattgcttgagcccaggcttgatgactaatttgtagtcattaagttaagttctacaggctttctaattagccttgctgatctatatcttgtctttacttgagatcaagcaagagacaggctccttagcaaaaatatgctgtcatgtcaggaggtgagacctggacacacagaagaatcaagattctctcagatctgagcccttcatttttcagatgaagatttttttcagtgtgtctgagacag

SEQ ID NO: 287214 - DNA, 283 bp, Homo sapiens
ccaggcaataggtatttgttgaattgaaccaaatacatttattgtgaaggaatgttttgacttcaacctcatttttgctttcaggcacagtaacagctgccaatgccagtacactgaatgatggagcagctgctctggttctcatgacggcagatgcagcgaagaggctcaatgttacaccactggcaagaatagtaggtaaggccaggcgaggtggctcacacctgtaatcccagcactttcggaggttgaggtgggaggattgcttgagccccggagttcg

SEQ ID NO: 287215 - DNA, 170 bp, Homo sapiens
accagaagtaaagcagcatgggaagctgggaaatttggaaatgaagttattcctgtcacagttacagtaaaaggtagagataatgttccaaaaaggatgaatagacttttcatgttgctgaatgttttatgcttaagttttaaattaggacattatcttggttcatttca

SEQ ID NO: 287216 - DNA, 1957 bp, Homo sapiens
aggccgctagggtgcggggttggggaggaggccgctagtctacgcctgtggagccgatactcagccctctgcgaccatggctgtgctggcggcacttctgcgcagcggcgcccgcagccgcagccccctgctccggaggctggtgcaggaaataagatatgtggaacggagttatgtatcaaaacccactttgaaggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcaggatgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatgggcagctgtgctgagaatacagcaaagaagctgaatattgcacgaaatgaacaggacgcttatgctattaattcttataccagaagtaaagcagcatgggaagctgggaaatttggaaatgaagttattcctgtcacagttacagtaaaaggtcaaccagatgtagtggtgaaagaagatgaagaatataaacgtgttgattttagcaaagttccaaagctgaagacagttttccagaaagaaaatggcacagtaacagctgccaatgccagtacactgaatgatggagcagctgctctggttctcatgacggcagatgcagcgaagaggctcaatgttacaccactggcaagaatagtagcatttgctgacgctgctgtagaacctattgattttccaattgctcctgtatatgctgcatctatggttcttaaagatgtgggattgaaaaaagaagatattgcaatgtgggaagtaaatgaagcctttagtctggttgtactagcaaacattaaaatgttggagattgatccccaaaaagtgaatatcaatggaggagctgtttctctgggacatccaattgggatgtctggagccaggattgttggtcatttgactcatgccttgaagcaaggagaatacggtcttgccagtatttgcaatggaggaggaggtgcttctgccatgctaattcagaagctgtagacaacctctgctatttaaggagacaaccctatgtgaccagaaggcctgctgtaatcagtgtgactactgtgggtcagcttatattcagataagctgtttcattttttattattttctatgttaacttttaaaaatcaaaatgatgaaatcccaaaacattttgaaattaaaaataaatttcttcttctgcttttttcttggtaaccttgaaaaaaaacaacacacaagccaacagaagaaagacaagtcacactgctggggggcgcactcggggcccctgggaaagagcttctctgtacagacccaccacgcgtgaggcgcgccagagaggccccaaaaagagcgacaggcgacacacgcgtgggacaaaacgacggataccacaagaggaacaccgcgagggggccagggaacgagcagcgacgacggacatgccgtaaccgacagattaaagaaaacagccccgcgggggacaacacagaagcggttaaatggagaccacgcatcccataatgagaaatatcagagcgcaagaacgcggcggccatatcacaaacgagactcacaagcgaagccggccgacccaaccatttgccc

SEQ ID NO: 287217 - DNA, 1672 bp, Homo sapiens
aggccgctagggtgcggggttggggaggaggccgctagtctacgcctgtggagccgatactcagccctctgcgaccatggctgtgctggcggcacttctgcgcagcggcgcccgcagccgcagccccctgctccggaggctggtgcaggaaataagatatgtggaacggagttatgtatcaaaacccactttgaaggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcaggatgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatgggcagctgtgctgagaatacagcaaagaagctgaatattgcacgaaatgaacaggacgcttatgctattaattcttataccagaagtaaagcagcatgggaagctgggaaatttggaaatgaagttattcctgtcacagttacagtaaaaggtcaaccagatgtagtggtgaaagaagatgaagaatataaacgtgttgattttagcaaagttccaaagctgaagacagttttccagaaagaaaatggcacagtaacagctgccaatgccagtacactgaatgatggagcagctgctctggttctcatgacggcagatgcagcgaagaggctcaatgttacaccactggcaagaatagtagcatttgctgacgctgctgtagaacctattgattttccaattgctcctgtatatgctgcatctatggttcttaaagatgtgggattgaaaaaagaagatattgcaatgtgggaagtaaatgaagcctttagtctggttgtactagcaaacattaaaatgttggagattgatccccaaaaagtgaatatcaatggaggagctgtttctctgggacatccaattgggatgtctggagccaggattgttggtcatttgactcatgccttgaagcaaggagaatacggtcttgccagtatttgcaatggaggaggaggtgcttctgccatgctaattcagaagctgtagacaacctctgctatttaaggagacaaccctatgtgaccagaaggcctgctgtaatcagtgtgactactgtgggtcagcttatattcagataagctgtttcattttttattattttctatgttaacttttaaaaatcaaaatgatgaaatcccaaaacatgctaataaattaaaaaacaaacatctgcccaaacaaattttcctcgggggggggcccggtaaccattcccccctagttcgcctcttattaaaattcacgggccgctcctttaacaacgtcgtgaacggggaaaaacccgggggtttacccaag

SEQ ID NO: 287218 - DNA, 1554 bp, Homo sapiens
aggccgctagggtgcggggttggggaggaggccgctagtctacgcctgtggagccgatactcagccctctgcgaccatggctgtgctggcggcacttctgcgcagcggcgcccgcagccgcagccccctgctccggaggctggtgcaggaaataagatatgtggaacggagttatgtatcaaaacccactttgaaggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcaggatgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatgggcagctgtgctgagaatacagcaaagaagctgaatattgcacgaaatgaacaggacgcttatgctattaattcttataccagaagtaaagcagcatgggaagctgggaaatttggaaatgaagttattcctgtcacagttacagtaaaaggtcaaccagatgtagtggtgaaagaagatgaagaatataaacgtgttgattttagcaaagttccaaagctgaagacagttttccagaaagaaaatggcacagtaacagctgccaatgccagtacactgaatgatggagcagctgctctggttctcatgacggcagatgcagcgaagaggctcaatgttacaccactggcaagaatagtagcatttgctgacgctgctgtagaacctattgattttccaattgctcctgtatatgctgcatctatggttcttaaagatgtgggattgaaaaaagaagatattgcaatgtgggaagtaaatgaagcctttagtctggttgtactagcaaacattaaaatgttggagattgatccccaaaaagtgaatatcaatggaggagctgtttctctgggacatccaattgggatgtctggagccaggattgttggtcatttgactcatgccttgaagcaaggagaatacggtcttgccagtatttgcaatggaggaggaggtgcttctgccatgctaattcagaagctgtagacaacctctgctatttaaggagacaaccctatgtgaccagaaggcctgctgtaatcagtgtgactactgtgggtcagcttatattcagataagctgtttcattttttattattttctatgttaacttttaaaaatcaaaatgatgaaatcccaaaacattttttaaaagttaacatagaacaaaaaaaaaaaag

SEQ ID NO: 287219 - DNA, 1956 bp, Homo sapiens
gatccccggaccccatacacagttgtagacgagcatttatccagtgccatcatgcatgtttgtgatgtttgagaaaactgttttatgtacacaaaaaggcattcttacattgtcttgcagttagctgtgtacatgtttcctgagggcaggaattgtctccacccatatttgtaatttctttaaacatttagcagcccaggcaataggtatttgttgaattgaaccaaatacatttattgtgaaggaatgttttgacttcaacctcatttttgctttcaggcacagtaacagctgccaatgccagtacactgaatgatggagcagctgctctggttctcatgacggcagatgcagcgaagaggctcaatgttacaccactggcaagaatagtagcatttgctgacgctgctgtagaacctattgattttccaattgctcctgtatatgctgcatctatggttcttaaagatgtgggattgaaaaaagaagatattgcaatgtgggaagtaaatgaagcctttagtctggttgtactagcaaacattaaaatgttggagattgatccccaaaaagtgaatatcaatggaggagctgtttctctgggacatccaattgggatgtctggagccaggattgttggtcatttgactcatgccttgaagcaaggagaatacggtcttgccagtatttgcaatggaggaggaggtgcttctgccatgctaattcagaagctgtagacaacctctgctatttaaggagacaaccctatgtgaccagaaggcctgctgtaatcagtgtgactactgtgggtcagcttatattcagataagctgtttcattttttattattttctatgttaacttttaaaaatcaaaatgatgaaatcccaaaacattttgaaattaaaaataaatttcttcttctgcttttttcttggtaaccttgaaaagtttgatacatttttgcattctgagtctatacttatcgaaatatggtagaaataccaatgtgtaatattagtgacttacataagtagctagaagtttccatttgtgagaacacatttatatttttgaggattgttaaaggtcaagtgaatgctctttataggtaatttacatttagtaaattacggtaaattaaattacttctctttacagtaagagttggctattctggacaaactagcagtgcttcatataatcactcaaaccacagtgtgtgcagcagtactagaaacaagacagaagcccatgtcctcagggtctagagtgggggcaatttcttataacctcaacattcagggttgggggaggtcaagcagaaaaccctggagtttgggctctgaattactatagcagcatagagagtgggaagggaggtagaaactgatatgctgaatggatatataaaaaagggaacagatcaccacttccaatacacgacaatgcctgttcttaagcaggacagactgtaacagaagtatctcgcattgcattttatctgggaaaaaattaattaaaacgctacaggcaggggctatgcacactaccctcaattgcagctctgaagagggaaaactccccctcaggaagaggagggggcagtaaaggtcattgtgtacacattatctgttggcaaataatgtattgtagatcttttgaaggagcaaaatgacaatatatgggagaaatagattagattgctcttcagattcagaggaagagtagagtattttcaaaaacatctgtaatcatcaccaacttttgaggcttgttatgtgctttatatgtataaactcatttaattgtcacaaaaacttctaagagtgggtaccattattatccctcctttataaacaaggaaattgaggcatagagtagctaaataaattccaagggcaaaaagctggctaggattcaactccaagttagtcaagctccagagcccacgtt

SEQ ID NO: 287220 - DNA, 1252 bp, Homo sapiens
aggccgctagggtgcggggttggggaggaggccgctagtctacgcctgtggagccgatactcagccctctgcgaccatggctgtgctggcggcacttctgcgcagcggcgcccgcagccgcagccccctgctccggaggctggtgcaggaaataagatatgtggaacggagttatgtatcaaaacccactttgaaggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcaggatgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatgggcagctgtgctgagaatacagcaaagaagctgaatattgcacgaaatgaacaggacgcttatgctattaattcttataccagaagtaaagcagcatgggaagctgggaaatttggaaatgaagttattcctgtcacagttacagtaaaaggtcaaccagatgtagtggtgaaagaagatgaagaatataaacgtgttgattttagcaaagttccaaagctgaagacagttttccagaaagaaaatggcacagtaacagctgccaatgccagtacactgaatgatggagcagctgctctggttctcatgacggcagatgcagcgaagaggctcaatgttacaccactggcaagaatagtagcatttgctgacgctgctgtagaacctattgattttccaattgctcctgtatatgctgcatctatggtgagaacaaagtgaggggcgatactccattatgctagcttctggtttgcttataccaaggttgcagtttttaagattttaaatgttatctgccaaagcagagagatagcttggtttcaaatcttcccatgtcttctcctgaaaagagtaagagcaacaaggataacaaac

SEQ ID NO: 287221 - DNA, 473 bp, Homo sapiens
ctgttgaagatggagttgctctggttcaaagagctctgacaataacaattagaaccccatgtgaagtagatttttctggatgaaattgtttagagaagttccattgtaaacaaagccacatagcatcacactttttacccaaggttttactatactgcagacttttgtgtacgttttgagaacatccaagacataaacctgaccagagaagaagggagattgtatccaagaataatagggatttagatttgctggtcagaatggagccagacattcagtttgagtacggttgatggtacgtttttgagatgacttccagctgcagcggcgactttcagtttcatttccacggacccatttataaccgcgacttcaagatcagagacagggttacccaagctctgttaaccaagctggagtgcagtggcgtaatcacagctcactgcagccttgacctcctgggctcaagtgat

SEQ ID NO: 287222 - DNA, 287 bp, Homo sapiens
actgccgtttgtggcgacctagaggatcccctgctgcaactgggacgcaaagaagggggagtatgtatttcccgccaagaagaagctgcaggaataccgggtcttaattaccaccctcatcactgccggcaggttcgtcctcaagaacacccagtgcatcccagaaggcttggagagctactacgcggagcaagactccagtgcccgggagaaattttacacagtcataagccactacaacctggccaagcagagcatcacgcgctccgtatcgtcccggatatgct

SEQ ID NO: 287223 - DNA, 3803 bp, Homo sapiens
  misc_feature (3803)..(3803): n is a, c, g, or t
ctgccttttgctctgttgcttttcactgagtcccgaggctctggagggtgggcgtgagggtagccctggctgaggctcggaggtcctcccgggctgttcagagggccccaagcggtagccacgttctgatactggctagaagccagggagggagcttggggtaaggggagggccctgagggaggggtcagacgctttaggaaagagttaatgcgaagagggggaggggataggacgaagaaaccgaagggaaagctcagacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287224 - DNA, 3913 bp, Homo sapiens
  misc_feature (3913)..(3913): n is a, c, g, or t
ctgccttttgctctgttgcttttcactgagtcccgaggctctggagggtgggcgtgagggtagccctggctgaggctcggaggtcctcccgggctgttcagagggccccaagcggtagccacgttctgatactggctagaagccagggagggagcttggggtaaggggagggccctgagggaggggtcagacgctttaggaaagagttaatgcgaagagggggaggggataggacgaagaaaccgaagggaaagctcaggtaagaaaagaacggaggagggaagcctggtggggagaagggagcccgcaggatcaggggtcagagttagggggcttccctcctgctgcaccctcatctcagggccgccaacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287225 - DNA, 4551 bp, Homo sapiens
  misc_feature (4551)..(4551): n is a, c, g, or t
ctgccttttgctctgttgcttttcactgagtcccgaggctctggagggtgggcgtgagggtagccctggctgaggctcggaggtcctcccgggctgttcagagggccccaagcggtagccacgttctgatactggctagaagccagggagggagcttggggtaaggggagggccctgagggaggggtcagacgctttaggaaagagttaatgcgaagagggggaggggataggacgaagaaaccgaagggaaagctcagacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagtcttgcctccagcaaatccatcctccaatcctgatgccagagtgatctgaaatgcaaatatgatcttgccactcccctgcttaaaacccaccaaccgcagtggttctgtaaccacagtgtagcctctgacgtgggctgaaagcacaaagccaggctatttgatctctggagaaggatcctttcccttcctgcttgggttccacctgcaccctatgacttcgggtggaaactgctgtctgatcagccaccttgcccacacacttggacatctgtactgtctctgatcccttctctcctcaccaacaggctggaccccacatccacccctctgaatcaaatcattccgcttccccttagcctcagctctttcttctgggttgtttgtattttcttttctgtcccaaacagtttcccccacaaaaagaactttatgtctttctctgtcttccctcagtccttccagtcagcagcctgtgattgggcttttcccctcagaaacgaacaatccagaacccactgtttaaaacaactgtattttgccttgggaagtcccattgccttccctgaaaacattaaacattcctccgatccccagcctgagtctctctgtctctgggccccatcctgctccacagcagggctggtgtgtccagcacagagtgaccctccgatgccctttcccacccgccgccctgcctccctcgagccctgccttccctcacttcccagtctcctctgcttctggcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287226 - DNA, 4039 bp, Homo sapiens
  misc_feature (4039)..(4039): n is a, c, g, or t
ctgccttttgctctgttgcttttcactgagtcccgaggctctggagggtgggcgtgagggtagccctggctgaggctcggaggtcctcccgggctgttcagagggccccaagcggtagccacgttctgatactggctagaagccagggagggagcttggggtaaggggagggccctgagggaggggtcagacgctttaggaaagagttaatgcgaagagggggaggggataggacgaagaaaccgaagggaaagctcagacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtcaggtcctcagttaccagcaagggtggggcccctcccccagatggtacctccttaatatccagaccactaggcagaggctccaggagcttaggcctctgctggctccgtatctcagaagagcaccaaggtcagctgccgcctccctttgttccccagctccctggcctcctgccaggctccctcttgcattaggttaatggcacgagagaaaggcacctgtcccctccttccaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287227 - DNA, 3880 bp, Homo sapiens
  misc_feature (3880)..(3880): n is a, c, g, or t
ctgccttttgctctgttgcttttcactgagtcccgaggctctggagggtgggcgtgagggtagccctggctgaggctcggaggtcctcccgggctgttcagagggccccaagcggtagccacgttctgatactggctagaagccagggagggagcttggggtaaggggagggccctgagggaggggtcagacgctttaggaaagagttaatgcgaagagggggaggggataggacgaagaaaccgaagggaaagctcagacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacagctccctggcctcctgccaggctccctcttgcattaggttaatggcacgagagaaaggcacctgtcccctccttccaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287228 - DNA, 4721 bp, Homo sapiens
  misc_feature (4721)..(4721): n is a, c, g, or t
ctgccttttgctctgttgcttttcactgagtcccgaggctctggagggtgggcgtgagggtagccctggctgaggctcggaggtcctcccgggctgttcagagggccccaagcggtagccacgttctgatactggctagaagccagggagggagcttggggtaaggggagggccctgagggaggggtcagacgctttaggaaagagttaatgcgaagagggggaggggataggacgaagaaaccgaagggaaagctcagacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacagctccctggcctcctgccaggctccctcttgcattaggttaatggcacgagagaaaggcacctgtcccctccttccaggtggagaaaatccgttactgcatcaccaaacttgacagggagcttcgaggactggatgacatcaaggacttgaaggtgacatgctgttccacagtcactccctgccttccgtgtgcccccacttgcccacttccagagacttcctcaagcttccactccagcccacgtccccgtcccacccctgctgccttgaatagagctcgagctctccctgagcctctcactcctggagattccaacttaagggtctgggatgggatcaggaagcctgcatgtttaacaaacacctcctgtcattcttagactgaggcaggtttgaggcctctgccctaaggataaagtccaaattccgtggcctgtcatgtgatgctgccacccccacccccagtagcctctctcttaaggttctggtctcaacactggctgcagataacaatcacctggagagcttttaataccccgcccccatgccagggccccacccaccagctcatacagctatcggggcagagccagggcactggtagtttttacagcttctcaggtgattctaatatgcagccagggttgccgggttagggcccagggttgtatattcttaacagatacttagtgattgttttcaggaaagtttgaaagtcactgctctgagttcccgtgttctttgcaatgctgttttctttccttagaacactttgcaggccccagccctcagcaggattcaaccttcatgtttcagcttccacagcctacctcccatcccctttccctgggccgtgtcgcagcactggttcactcactgatctacaattgcccagtgacctctctgtaccctccttggaaggcaagctccctggggtagggcacccctttgacacccctggctggtctcaggccctgcctctttccccactaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287229 - DNA, 4775 bp, Homo sapiens
  misc_feature (4775)..(4775): n is a, c, g, or t
ctgccttttgctctgttgcttttcactgagtcccgaggctctggagggtgggcgtgagggtagccctggctgaggctcggaggtcctcccgggctgttcagagggccccaagcggtagccacgttctgatactggctagaagccagggagggagcttggggtaaggggagggccctgagggaggggtcagacgctttaggaaagagttaatgcgaagagggggaggggataggacgaagaaaccgaagggaaagctcagacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacagctccctggcctcctgccaggctccctcttgcattaggttaatggcacgagagaaaggcacctgtcccctccttccaggtggagaaaatccgttactgcatcaccaaacttgacagggagcttcgaggactggatgacatcaaggacttgaaggtgacatgctgttccacagtcactccctgccttccgtgtgcccccacttgcccacttccagagacttcctcaagcttccactccagcccacgtccccgtcccacccctgctgccttgaatagagctcgagctctccctgagcctctcactcctggagattccaacttaagggtctgggatgggatcaggaagcctgcatgtttaacaaacacctcctgtcattcttagactgaggcaggtttgaggcctctgccctaaggataaagtccaaattccgtggcctgtcatgtgatgctgccacccccacccccagtagcctctctcttaaggttctggtctcaacactggctgcagataacaatcacctggagagcttttaataccccgcccccatgccagggccccacccaccagctcatacagctatcggggcagagccagggcactggtagtttttacagcttctcaggtgattctaatatgcagccagggttgaaaacactgctctaagacttacaggcctctctcttggaaattctgatcgggggtccgggttagggcccagggttgtatattcttaacagatacttagtgattgttttcaggaaagtttgaaagtcactgctctgagttcccgtgttctttgcaatgctgttttctttccttagaacactttgcaggccccagccctcagcaggattcaaccttcatgtttcagcttccacagcctacctcccatcccctttccctgggccgtgtcgcagcactggttcactcactgatctacaattgcccagtgacctctctgtaccctccttggaaggcaagctccctggggtagggcacccctttgacacccctggctggtctcaggccctgcctctttccccactaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287230 - DNA, 4644 bp, Homo sapiens
  misc_feature (4644)..(4644): n is a, c, g, or t
ctgccttttgctctgttgcttttcactgagtcccgaggctctggagggtgggcgtgagggtagccctggctgaggctcggaggtcctcccgggctgttcagagggccccaagcggtagccacgttctgatactggctagaagccagggagggagcttggggtaaggggagggccctgagggaggggtcagacgctttaggaaagagttaatgcgaagagggggaggggataggacgaagaaaccgaagggaaagctcagacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgacatgctgttccacagtcactccctgccttccgtgtgcccccacttgcccacttccagagacttcctcaagcttccactccagcccacgtccccgtcccacccctgctgccttgaatagagctcgagctctccctgagcctctcactcctggagattccaacttaagggtctgggatgggatcaggaagcctgcatgtttaacaaacacctcctgtcattcttagactgaggcaggtttgaggcctctgccctaaggataaagtccaaattccgtggcctgtcatgtgatgctgccacccccacccccagtagcctctctcttaaggttctggtctcaacactggctgcagataacaatcacctggagagcttttaataccccgcccccatgccagggccccacccaccagctcatacagctatcggggcagagccagggcactggtagtttttacagcttctcaggtgattctaatatgcagccagggttgccgggttagggcccagggttgtatattcttaacagatacttagtgattgttttcaggaaagtttgaaagtcactgctctgagttcccgtgttctttgcaatgctgttttctttccttagaacactttgcaggccccagccctcagcaggattcaaccttcatgtttcagcttccacagcctacctcccatcccctttccctgggccgtgtcgcagcactggttcactcactgatctacaattgcccagtgacctctctgtaccctccttggaaggcaagctccctggggtagggcacccctttgacacccctggctggtctcaggccctgcctctttccccactaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287231 - DNA, 4717 bp, Homo sapiens
  misc_feature (4717)..(4717): n is a, c, g, or t
ctgccttttgctctgttgcttttcactgagtcccgaggctctggagggtgggcgtgagggtagccctggctgaggctcggaggtcctcccgggctgttcagagggccccaagcggtagccacgttctgatactggctagaagccagggagggagcttggggtaaggggagggccctgagggaggggtcagacgctttaggaaagagttaatgcgaagagggggaggggataggacgaagaaaccgaagggaaagctcagacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacagctccctggcctcctgccaggctccctcttgcattaggttaatggcacgagagaaaggcacctgtcccctccttccaggtggagaaaatccgttactgcatcaccaaacttgacagggagcttcgaggactggatgacatcaaggacttgaaggtgacatgctgttccacagtcactccctgccttccgtgtgcccccacttgcccacttccagagacttcctcaagcttccactccagcccacgtccccgtcccacccctgctgccttgaatagagctcgagctctccctgagcctctcactcctggagattccaacttaagggtctgggatgggatcaggaagcctgcatgtttaacaaacacctcctgtcattcttagactgaggcaggtttgaggcctctgccctaaggataaagtccaaattccgtggcctgtcatgtgatgctgccacccccacccccagtagcctctctcttaaggttctggtctcaacactggctgcagataacaatcacctggagagcttttaataccccgcccccatgccagggccccacccaccagctcatacagctatcggggcagagccagggcactggtagtttttacagcttctcaggtgattctaatatgcagccagggttgaaaacactgctctaagacttacaggcctctctcttggaaattctgatcgggggtccgggttagggcccagggttgtatattcttaacagatacttagtgattgttttcaggaaagtttgaaagtcactgctctgagttcccgtgttctttgcaatgctgttttctttccttagaactacctcccatcccctttccctgggccgtgtcgcagcactggttcactcactgatctacaattgcccagtgacctctctgtaccctccttggaaggcaagctccctggggtagggcacccctttgacacccctggctggtctcaggccctgcctctttccccactaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287232 - DNA, 3115 bp, Homo sapiens
  misc_feature (3115)..(3115): n is a, c, g, or t
tagttcctccacttcagggctgtctccagctgggccttgatctctgcgatctccttaggggcagtgaagatacttgttccctgaagaagcatggggagcagctgcctgaggcggggaggtgggtagtatgtccccagcgccatacttaactccaggtcatagcccttagcgcggtcaggtctctctccttcctctatccgattggtcaccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287233 - DNA, 3044 bp, Homo sapiens
  misc_feature (3044)..(3044): n is a, c, g, or t
cgagctcggtaccctttgggctcccttcagggggctcaggctttactggagcaaggaggaaggctgtcttctttctacccccctggggccggtgtcacagctctcagcccggacccaccaaggattttgagtttccgggctcagcatcatgtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287234 - DNA, 4591 bp, Homo sapiens
  misc_feature (4591)..(4591): n is a, c, g, or t
ctgccttttgctctgttgcttttcactgagtcccgaggctctggagggtgggcgtgagggtagccctggctgaggctcggaggtcctcccgggctgttcagagggccccaagcggtagccacgttctgatactggctagaagccagggagggagcttggggtaaggggagggccctgagggaggggtcagacgctttaggaaagagttaatgcgaagagggggaggggataggacgaagaaaccgaagggaaagctcagacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctccctcttgcattaggttaatggcacgagagaaaggcacctgtcccctccttccaggtggagaaaatccgttactgcatcaccaaacttgacagggagcttcgaggactggatgacatcaaggacttgaaggtgacatgctgttccacagtcactccctgccttccgtgtgcccccacttgcccacttccagagacttcctcaagcttccactccagcccacgtccccgtcccacccctgctgccttgaatagagctcgagctctccctgagcctctcactcctggagattccaacttaagggtctgggatgggatcaggaagcctgcatgtttaacaaacacctcctgtcattcttagactgaggcaggtttgaggcctctgccctaaggataaagtccaaattccgtggcctgtcatgtgatgctgccacccccacccccagtagcctctctcttaaggttctggtctcaacactggctgcagataacaatcacctggagagcttttaataccccgcccccatgccagggccccacccaccagctcatacagctatcggggcagagccagggcactggtagtttttacagcttctcaggtgattctaatatgcagccagggttgccgggttagggcccagggttgtatattcttaacagatacttagtgattgttttcaggaaagtttgaaagtcactgctctgagttcccgtgttctttgcaatgctgttttctttccttagaacactttgcaggccccagccctcagcaggattcaaccttcatgtttcagcttccacagcctacctcccatcccctttccctgggccgtgtcgcagcactggttcactcactgatctacaattgcccagtgacctctctgtaccctccttggaaggcaagctccctggggtagggcacccctttgacacccctggctggtctcaggccctgcctctttccccactaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287235 - DNA, 2444 bp, Homo sapiens
  misc_feature (2444)..(2444): n is a, c, g, or t
aggttagaaggccagtctcagtccttgtcccttaaaggtctggggaacctgggggctgggccctccagcgtccatccctgggacagaagcttgcttgtgttcacaccccataggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287236 - DNA, 4039 bp, Homo sapiens
  misc_feature (4039)..(4039): n is a, c, g, or t
ctgccttttgctctgttgcttttcactgagtcccgaggctctggagggtgggcgtgagggtagccctggctgaggctcggaggtcctcccgggctgttcagagggccccaagcggtagccacgttctgatactggctagaagccagggagggagcttggggtaaggggagggccctgagggaggggtcagacgctttaggaaagagttaatgcgaagagggggaggggataggacgaagaaaccgaagggaaagctcagacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtgtgagcattcccaccccattctccctcttagtggccacagcccctgcctagggcaggtggatcttttttaagcgcttgcttatcgctcagttaatcctcagatgtgtccattttcacagcatcactattgtatttataagttaaatgacatccagaggttgagcaagtacagctcagatgggacaggaccgtggcttagcctccagtctctgctggcactcctctgtaccccacagattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287237 - DNA, 4341 bp, Homo sapiens
  misc_feature (4341)..(4341): n is a, c, g, or t
ctgccttttgctctgttgcttttcactgagtcccgaggctctggagggtgggcgtgagggtagccctggctgaggctcggaggtcctcccgggctgttcagagggccccaagcggtagccacgttctgatactggctagaagccagggagggagcttggggtaaggggagggccctgagggaggggtcagacgctttaggaaagagttaatgcgaagagggggaggggataggacgaagaaaccgaagggaaagctcagacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacagctccctggcctcctgccaggctccctcttgcattaggttaatggcacgagagaaaggcacctgtcccctccttccaggtggagaaaatccgttactgcatcaccaaacttgacagggagcttcgaggactggatgacatcaaggacttgaagcactttgcaggccccagccctcagcaggattcaaccttcatgtttcagcttccacagcctacctcccatcccctttccctgggccgtgtcgcagcactggttcactcactgatctacaattgcccagtgacctctctgtaccctccttggaaggcaagctccctggggtagggcacccctttgacacccctggctggtctcaggccctgcctctttccccactaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtgtgagcattcccaccccattctccctcttagtggccacagcccctgcctagggcaggtggatcttttttaagcgcttgcttatcgctcagttaatcctcagatgtgtccattttcacagcatcactattgtatttataagttaaatgacatccagaggttgagcaagtacagctcagatgggacaggaccgtggcttagcctccagtctctgctggcactcctctgtaccccacagattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287238 - DNA, 3773 bp, Homo sapiens
  misc_feature (3773)..(3773): n is a, c, g, or t
ctgccttttgctctgttgcttttcactgagtcccgaggctctggagggtgggcgtgagggtagccctggctgaggctcggaggtcctcccgggctgttcagagggccccaagcggtagccacgttctgatactggctagaagccagggagggagcttggggtaaggggagggccctgagggaggggtcagacgctttaggaaagagttaatgcgaagagggggaggggataggacgaagaaaccgaagggaaagctcagacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287239 - DNA, 3092 bp, Homo sapiens
ctgccttttgctctgttgcttttcactgagtcccgaggctctggagggtgggcgtgagggtagccctggctgaggctcggaggtcctcccgggctgttcagagggccccaagcggtagccacgttctgatactggctagaagccagggagggagcttggggtaaggggagggccctgagggaggggtcagacgctttaggaaagagttaatgcgaagagggggaggggataggacgaagaaaccgaagggaaagctcagacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacagctccctggcctcctgccaggctccctcttgcattaggttaatggcacgagagaaaggcacctgtcccctccttccaggtggagaaaatccgttactgcatcaccaaacttgacagggagcttcgaggactggatgacatcaaggacttgaaggtgacatgctgttccacagtcactccctgccttccgtgtgcccccacttgcccacttccagagacttcctcaagcacgtgagcagcatggtaccgagctg

SEQ ID NO: 287240 - DNA, 1304 bp, Homo sapiens
  misc_feature (1304)..(1304): n is a, c, g, or t
ggagtgtcctgctatccagggagccagcggggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287241 - DNA, 1131 bp, Homo sapiens
  misc_feature (1131)..(1131): n is a, c, g, or t
ttcgagtcgcgtcttgagtggttcttcttagaatttgaggccagctcagagatcaactcagttcagttcaaagctactacctcccatcccctttccctgggccgtgtcgcagcactggttcactcactgatctacaattgcccagtgacctctctgtaccctccttggaaggcaagctccctggggtagggcacccctttgacacccctggctggtctcaggccctgcctctttccccactaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287242 - DNA, 2309 bp, Homo sapiens
  misc_feature (2309)..(2309): n is a, c, g, or t
ctgccttttgctctgttgcttttcactgagtcccgaggctctggagggtgggcgtgagggtagccctggctgaggctcggaggtcctcccgggctgttcagagggccccaagcggtagccacgttctgatactggctagaagccagggagggagcttggggtaaggggagggccctgagggaggggtcagacgctttaggaaagagttaatgcgaagagggggaggggataggacgaagaaaccgaagggaaagctcagacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287243 - DNA, 1753 bp, Homo sapiens
ctgccttttgctctgttgcttttcactgagtcccgaggctctggagggtgggcgtgagggtagccctggctgaggctcggaggtcctcccgggctgttcagagggccccaagcggtagccacgttctgatactggctagaagccagggagggagcttggggtaaggggagggccctgagggaggggtcagacgctttaggaaagagttaatgcgaagagggggaggggataggacgaagaaaccgaagggaaagctcagacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggtcagggctcagattgagtgtgaggagggtgggctcaagccagccaagctagaggctgtgggcagaactattcctgacagcagggcagaacaagaggaaagttgaagtggttcccagggctccgcaagaagcagggtgggcatcctgtgcccaaagatgtgttggagcagggaaatggggaagatctgggttctagtccaggctttgctaccaccttgggtaagtccctggctttctctaagccttagttcccttatctgaaaagcacagagctggactgg

SEQ ID NO: 287244 - DNA, 1422 bp, Homo sapiens
  misc_feature (1422)..(1422): n is a, c, g, or t
tatcctcccgtgaaaataatataatctctaaacataactaaactccatccttgacgacacaccaatttcttttttcctacccccccccctcagcatataatactcgccctgttgtttttatcctccccctcatatctctacaccctatcaccgcatatttatttattattattttcttcctcagcctgatcggcgctgtatctatcaatctttcctcggcgaaggaggtgtgtgtgtcttccctcgcttttgtgtttcctccccctctccgcagcgaatagttggattcttcttttcttccctcagtagtatcgctcctctctcgcgctttttttgtcctcctcgccctcccttgtttgttgttttttataagaccggccccgccggcgtgcgtttatttagtctcctcctctctgagggggcgccccttccttcttattcacaaacgggtgtggcgtgctgcatggtgtgggtgcgcgccctccgggaggaaatgaatatggggcgggcgcccgcccctctctcttttttttttttttttttttttttttttttttttttttttttttttttttttttttttttttttttttttttttttttttttttttttttttttttttttttcacagcatcactattgtatttataagttaaatgacatccagaggttgagcaagtacagctcagatgggacaggaccgtggcttagcctccagtctctgctggcactcctctgtaccccacagattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287245 - DNA, 628 bp, Homo sapiens
  misc_feature (628)..(628): n is a, c, g, or t
ctggaaagtattcctggagttctgtaaaggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaacacacccgagagcgactccaagtagacggggaatgcgacacaacaccagcggttatctgcacagtgcggcccaaggggccacaataacgcatggtccccagaggacccaaagacgtccgtgtgctccaccagggggaaagactacctgccgggaactccctaataggaagaagacgataaacaatttcgaatagagccagggttaacccggagtatgan

SEQ ID NO: 287246 - DNA, 833 bp, Homo sapiens
ctgccttttgctctgttgcttttcactgagtcccgaggctctggagggtgggcgtgagggtagccctggctgaggctcggaggtcctcccgggctgttcagagggccccaagcggtagccacgttctgatactggctagaagccagggagggagcttggggtaaggggagggccctgagggaggggtcagacgctttaggaaagagttaatgcgaagagggggaggggataggacgaagaaaccgaagggaaagctcagacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggcaatcccctggcccccatttcaaccccccaatggccagctcccctaaccccccctggactctaccccctaacacgggccccctccctctgggcccttcgaatagccggacccccctcttgtt

SEQ ID NO: 287247 - DNA, 287 bp, Homo sapiens
ttttcacagcatcactattgtatttataagttaaatgacatccagaggttgagcaagtacagctcagatgggacaggaccgtggcttagcctccagtctctgctggcactcctctgtaccccacagattcctggagttctgtaaagaaaacggagggtataccgggtgtcccttccctgccaaactggacctgcaacagggacagaatttactgcaaggtctgagcaagctcagcccctctacctcaggtatggctgggccagggtggggacagtgccagaggaggt

SEQ ID NO: 287248 - DNA, 603 bp, Homo sapiens
cgacaccagacgaccacctgtctgggagtgcaatctcaccatcacaacgcctgaaggactgaaggccagccagagccgggcagggcagactgacggacggacgacggacatgcggatgtgtcccacgcctctgcgctgaggacagggacgccctgcgccagctgcagcccagtcggccgggccccggcgagtgcacgctggaccacggctccaagctcttctttcggcgcctctgaccctggcgctgcctttccccaccctcaccgaagcccctaataaatgaagctgctggccgggcgcggtggctcacgcctgtaatcccaacactttgggaggcccaggcgggcggatcacgaggtcaggagatcgagaccatcctggctaacatggtgaaaccccgtctctactaaaaataccaaaaattagccgggcgtggtggtggaagcctgtagtcccagctactccggaggctgaggcaggagaatggcgtgaacccgggaggcggagcttgcagtgagccgagatcgcaccactgcactccagcctgggcgacagaccgagactccgtctcaaaaaaaaaaaaaaataaaataaatgaagctg

SEQ ID NO: 287249 - DNA, 269 bp, Homo sapiens
cctccctgtgctgtccacctcctctgtgctgcctcctcagtgctcctcctctgggacagcacagaggaggccggcgaggtggagctctcagagagcggtgagggccagcggcaccttgcatttccctgggcctgctctgggccgggctggagaggggtgtgctgtgctgctgtggagcctgcttagggctgtagcaggaacagccacaggccgccccaggctcccggcgggtcaccacctcctctgtgctgtcggacagcacagaggag

SEQ ID NO: 287250 - DNA, 4352 bp, Homo sapiens
  misc_feature (2890)..(2890): n is a, c, g, or t
aattcgcgtactagccggacttggattttctggaaagatttcagttgaggaacgggaacaaagattatgatagctttccgaccaccaccaacttcaatttccttagctgccgtaatatcagctccctgagctgagccttgaggtccgagttcatctccagctccagaagagcctgggagatgccggactcgaactcgtccgcttctcgccattgggcttcacgatcttggcgctcgaactgaacatggcttctcctttgagaagagcttggctattgtggatgaggagctggaggggacactggcccagggagagctgaatgagatgaggacccgcctctatctcaacctgggcctcacctttgagagcctgcagcagacagccctgtgcaacgattacttcaggaagagcatcttccttgcggagcagaaccacctttacgaggacctattccgcgcccgctacaacctgggcaccatccactggcgcgcgggccagcactcccaggctatgcgctgcttggagggtgcccgggagtgtgcgcacaccatgaggaagcggttcatggagagcgagtgctgcgtggttattgcacaggtcctccaagacctgggagactttttggctgccaagcgagccctgaagaaggcgctacaggctgggctcccagaagcctgtgcagagggcagccatctgtcagaacctccagcatgtgctggcagtggtccggctgcagcaacagctggaagaggctgagggcagagaccctcagggtgccatggtcatctgtgagcagctaggggacctcttctccaaggcaggagactttcccagggcagctgaggcttaccagaagcagctgcgttttgctgagctgctggacagaccgggtgctgagcgggccatcatccacgtgtccctggccaccacactgggagacatgaaggaccaccatggggccgtgcgccactatgaggaggaactgaggctgcgcagcggcaacgtgctggaggaggccaagacctggctgaacattgcactgtcccgcgaggaggccggcgatgcctacgagctgctggccccgtgcttccagaaagcgctcagctgtgcccagcaggcccagcgtccccagctgcagaggcaggtcttgcagcatctccataccgtgcagctgaggctgcagccccaggaggcccctgagaccgaaaccagactgcgggagctcagtgtagctgaagatgaagatgaggaggaggaggcggaggaggcggcagccacagcggagagcgaagccctggaggccggcgaggtggagctctcagagagcgaggacgacaccgatggcctgaccccgcagctggaggaggacgaggagcttcagggccacctgggccggcggaaggggagcaagtggaaccggcgaaacgacatgggggagaccctgctgcaccgagcctgcatcgagggccagctgcgccgcgtccaggaccttgtgaggcagggccacccccttaaccctcgggactactgtggctggacacctctgcacgaggcctgcaactacgggcatctagaaattgtccgcttcctgctggaccacggggccgcagtggacgacccaggtggccagggctgcgaaggcatcacccccctccacgatgccctcaactgtggccacttcgaggtggctgagctgctgcttgaacggggggcgtccgtcaccctccgcactcgaaagggcctcagcccgctggagacgctgcagcagtgggtgaagctgtaccgcagggacctggacctggagacgcggcagaaggccagggccatggagatgctgctccaggcggctgcctcgggccaagatccccacagctcccaggccttccacaccccaagcagccttctgtttgaccccgagacctctcctcctttgagcccctgcccagaacccccctctaatagcactagactcccagaggcctctcaggcccatgtcagggtctccccagggcaggcggcaccagccatggccaggcctcggaggagcaggcatgggccagccagcagcagcagcagctcagaaggcgaggacagcgcaggccccgcacggccgtcccagaagaggcctcggtgctcggccacagcacaacgggtggcagcctggacgcctggccccgccagcaacagggaagcagccacagccagcaccagccgggcagcctaccaggcagccatccggggtgtgggcagtgctcagagccggctggggcctggcccaccgcggggccacagcaaagcccttgccccccaggcagcgctcatcccggaggaggagtgcctggctggggactggctggagctggacatgcccctgacccgcagccgccggccccgcccccggggcactggagacaaccgcaggcccagtagtacctctgggtcggacagtgaggagagcaggccccgtgcccgagccaagcaggtccgcctgacctgcatgcagagttgcagtgcgccagttaacgcagggcccagcagcctggcttcagaacctccagggagccccagcacccccagggtctcagagcccagtggggacagctctgcggcaggccagcccttgggtccggccccgccccctcccatccgggttcgagttcaagttcaggatcatctcttcctcatccctgtcccacacagcagtgacacccactctgtggcctggctggccgagcaggcggcccagcgctactaccagacctgcgggctgctgcccaggctcaccctacggaaagagggggccctgctggccccacaggacctcatccctgatgtgctgcagagcaatgacgaggtgttggctgaggtgacttcgtgggacctgcccccnttgactgaccgctaccgcagggcctgccagagcctggggcaaggggagcaccaacaggtgctgcaggccgtggagctccagggcttgggcctctcgttcagcgcctgctccctggccctggaccaggcccagcttacacccctgctgcgggccctcaagctgcacacagcactccgggagctgcgcctggcagggaaccggctgggggacaagtgtgtggctgagctggtggctgccctgggcaccatgcccagcctggccctccttgacctctcctccaatcacctgggtcccgaaggcctgcgccagcttgccatggggctcccaggccaagccaccttgcagagtttggaggagctggacttaagcatgaaccccctgggggacggctgtggccagtccctggcctccctcctgcacgcctgccccttactcagcaccctgcgcctgcaggcgtgtggcttcggccccagcttctttctgagccaccagacagcactgggtagtgctttccaagatgctgagcacctgaagaccctgtccctgtcctacaacgccctgggagcccctgccctggccaggaccctgcagagcctgcccgccggcaccctcctgcacttagagctcagctccgtggcagccggcaagggtgattcggacctcatggagcctgtattccgatacctggccaaggaaggctgtgctctagcccacctgaccctgtctgcaaaccacctgggggacaaggctgttagagacctgtgcagatgtctctctctgtgcccctcactcatctcactggatctgtctgccaaccctgagatcagctgtgccagcttggaagagctcctgtccaccctccaaaagcggccccaaggccttagcttccttggcctgtcaggctgcgccgtccagggtcccctgggcctgggcctgtgggacaagatagccgcgcagctccgggaactgcagctgtgcagcagacgcctctgcgctgaggacagggacgccctgcgccagctgcagcccagtcggccgggccccggcgagtgcacgctggaccacggctccaagctcttctttcggcgcctctgaccctggcgctgcctttccccaccctcaccgaagcccctaataaatgaagctgctggccgggcgcggtggctcacgcctgtaatcccaacactttgggaggcccaggcgggcggatcacgaggtcaggagatcgagaccatcctggctaacatggtgaaaccccgtctctactaaaaataccaaaaattagccgggcgtggtggtggaagcctgtagtcccagctactccggaggctgaggcaggagaatggcgtgaacccgggaggcggagcttgcagtgagccgagatcgcaccactgcactccagcctgggcgacagaccgagactccgtctcaaaaaaaaaaaaaaataaaataaatgaagctg

SEQ ID NO: 287251 - DNA, 3099 bp, Homo sapiens
  misc_feature (1637)..(1637): n is a, c, g, or t
ttgaccagctgggcttttatttcgcagccaccatcttcattggcaaactggagacagtagttgtacccctagcctcccagggtgggagaggagatggcacgcgtggtccaggagtgctgatggcagagaccaccattggaggttggcagccgtcagccctcactttgagccaggcaccatccatgttgtgttgtttttttttcttgagatggagtctcgctctgtcacccaggctggagtgagacccttggtggacacgtggggcgaagagtcagtcctggcggggcatcgggagctgggcttacgtctcctggtctgcagaaattgtccgcttcctgctggaccacggggccgcagtggacgacccaggtggccagggctgcgaaggcatcacccccctccacgatgccctcaactgtggccacttcgaggtggctgagctgctgcttgaacggggggcgtccgtcaccctccgcactcgaaagggcctcagcccgctggagacgctgcagcagtgggtgaagctgtaccgcagggacctggacctggagacgcggcagaaggccagggccatggagatgctgctccaggcggctgcctcgggccaagatccccacagctcccaggccttccacaccccaagcagccttctgtttgaccccgagacctctcctcctttgagcccctgcccagaacccccctctaatagcactagactcccagaggcctctcaggcccatgtcagggtctccccagggcaggcggcaccagccatggccaggcctcggaggagcaggcatgggccagccagcagcagcagcagctcagaaggcgaggacagcgcaggccccgcacggccgtcccagaagaggcctcggtgctcggccacagcacaacgggtggcagcctggacgcctggccccgccagcaacagggaagcagccacagccagcaccagccgggcagcctaccaggcagccatccggggtgtgggcagtgctcagagccggctggggcctggcccaccgcggggccacagcaaagcccttgccccccaggcagcgctcatcccggaggaggagtgcctggctggggactggctggagctggacatgcccctgacccgcagccgccggccccgcccccggggcactggagacaaccgcaggcccagtagtacctctgggtcggacagtgaggagagcaggccccgtgcccgagccaagcaggtccgcctgacctgcatgcagagttgcagtgcgccagttaacgcagggcccagcagcctggcttcagaacctccagggagccccagcacccccagggtctcagagcccagtggggacagctctgcggcaggccagcccttgggtccggccccgccccctcccatccgggttcgagttcaagttcaggatcatctcttcctcatccctgtcccacacagcagtgacacccactctgtggcctggctggccgagcaggcggcccagcgctactaccagacctgcgggctgctgcccaggctcaccctacggaaagagggggccctgctggccccacaggacctcatccctgatgtgctgcagagcaatgacgaggtgttggctgaggtgacttcgtgggacctgcccccnttgactgaccgctaccgcagggcctgccagagcctggggcaaggggagcaccaacaggtgctgcaggccgtggagctccagggcttgggcctctcgttcagcgcctgctccctggccctggaccaggcccagcttacacccctgctgcgggccctcaagctgcacacagcactccgggagctgcgcctggcagggaaccggctgggggacaagtgtgtggctgagctggtggctgccctgggcaccatgcccagcctggccctccttgacctctcctccaatcacctgggtcccgaaggcctgcgccagcttgccatggggctcccaggccaagccaccttgcagagtttggaggagctggacttaagcatgaaccccctgggggacggctgtggccagtccctggcctccctcctgcacgcctgccccttactcagcaccctgcgcctgcaggcgtgtggcttcggccccagcttctttctgagccaccagacagcactgggtagtgctttccaagatgctgagcacctgaagaccctgtccctgtcctacaacgccctgggagcccctgccctggccaggaccctgcagagcctgcccgccggcaccctcctgcacttagagctcagctccgtggcagccggcaagggtgattcggacctcatggagcctgtattccgatacctggccaaggaaggctgtgctctagcccacctgaccctgtctgcaaaccacctgggggacaaggctgttagagacctgtgcagatgtctctctctgtgcccctcactcatctcactggatctgtctgccaaccctgagatcagctgtgccagcttggaagagctcctgtccaccctccaaaagcggccccaaggccttagcttccttggcctgtcaggctgcgccgtccagggtcccctgggcctgggcctgtgggacaagatagccgcgcagctccgggaactgcagctgtgcagcagacgcctctgcgctgaggacagggacgccctgcgccagctgcagcccagtcggccgggccccggcgagtgcacgctggaccacggctccaagctcttctttcggcgcctctgaccctggcgctgcctttccccaccctcaccgaagcccctaataaatgaagctgctggccgggcgcggtggctcacgcctgtaatcccaacactttgggaggcccaggcgggcggatcacgaggtcaggagatcgagaccatcctggctaacatggtgaaaccccgtctctactaaaaataccaaaaattagccgggcgtggtggtggaagcctgtagtcccagctactccggaggctgaggcaggagaatggcgtgaacccgggaggcggagcttgcagtgagccgagatcgcaccactgcactccagcctgggcgacagaccgagactccgtctcaaaaaaaaaaaaaaataaaataaatgaagctg

SEQ ID NO: 287252 - DNA, 1875 bp, Homo sapiens
ggcacgagggcgagcttcgccagctgagcaaggcgaaagccaaggcgcagagggccgggcagcggcgcgaagaggccgcgctgtgccaccagctgggggagctcctggccggccatggccgctacgccgaggctctggagcagcactggcaggagctgcagcttcgggagcgcgctgacgaccctctgggctgtgccgtggcccaccgcaagatcggagagcgcctggccgagatggaggactacccggctgccttgcagcaccagcaccagtacctggagctggcacattccctgcgcaaccacacggagctgcagagggcctgggccaccatcggccgcacccacctggacatctatgaccactgccagtcgagggatgctttgctgcaggcacaggctgcctttgagaagagcttggctattgtggatgaggagctggaggggacactggcccagggagagctgaatgagatgaggacccgcctctatctcaacctgggcctcacctttgagagcctgcagcagacagccctgtgcaacgattacttcaggaagagcatcttccttgcggagcagaaccacctttacgaggacctattccgcgcccgctacaacctgggcaccatccactggcgcgcgggccagcactcccaggctatgcgctgcttggagggtgcccgggagtgtgcgcacaccatgaggaagcggttcatggagagcgagtgctgcgtggttattgcacaggtcctccaagacctgggagactttttggctgccaagcgagccctgaagaaggcgctacaggctgggctcccagaagcctgtgcagagggcagccatctgtcagaacctccagcatgtgctggcagtggtccggctgcagcaacagctggaagaggctgagggcagagaccctcagggtgccatggtcatctgtgagcagctaggggacctcttctccaaggcaggagactttcccagggcagctgaggcttaccagaagcagctgcgttttgctgagctgctggacagaccgggtgctgagcgggccatcatccacgtgtccctggccaccacactgggagacatgaaggaccaccatggggccgtgcgccactatgaggaggaactgaggctgcgcagcggcaacgtgctggaggaggccaagacctggctgaacattgcactgtcccgcgaggaggccggcgatgcctacgagctgctggccccgtgcttccagaaagcgctcagctgtgcccagcaggcccagcgtccccagctgcagaggcaggtcttgcagcatctccataccgtgcagctgaggctgcagccccaggaggcccctgagaccgaaaccagactgcgggagctcagtgtagctgaagatgaagatgaggaggaggaggcggaggaggcggcagccacagcggagagcgaagccctggaggccggcgaggtggagctctcagagagcgaggacgacaccgatggcctgaccccgcagctggaggaggacgaggagcttcagggccacctgggccggcggaaggggagcaagtggaaccggcgaaacgacatgggggagaccctgctgcaccgagcctcctctgcaggtcccaccctctccccctgctcgtacccccaagtgatagtcgttcggaccacggcagcatgcacaggggtacaaagaagagacacaagacagaaggaaagccgcacgacgagatcccgcgcgagccagccacaaacaagaacaaaaagaggaaaacaagcaacggacgaggagactaaagaagaggtcaggagcaagagcaaccaagacagagacgaggagcagacagggagcaagagcgaaaaaggaaaaccacaccga

SEQ ID NO: 287253 - DNA, 142 bp, Homo sapiens
ccccaaactctcctcgtgggccatcaaacagctgcctgccgccctcataacctccctcaacctccagcttgaaccacactccactgcagcccccgccccgctctcctgagtgtccatagtacctcactttttctggtagccc

SEQ ID NO: 287254 - DNA, 4501 bp, Homo sapiens
  misc_feature (3039)..(3039): n is a, c, g, or t
ggcacgagggcgagcttcgccagctgagcaaggcgaaagccaaggcgcagagggccgggcagcggcgcgaagaggccgcgctgtgccaccagctgggggagctcctggccggccatggccgctacgccgaggctctggagcagcactggcaggagctgcagcttcgggagcgcgctgacgaccctctgggctgtgccgtggcccaccgcaagatcggagagcgcctggccgagatggaggactacccggctgccttgcagcaccagcaccagtacctggagctggcacattccctgcgcaaccacacggagctgcagagggcctgggccaccatcggccgcacccacctggacatctatgaccactgccagtcgagggatgctttgctgcaggcacaggctgcctttgagaagagcttggctattgtggatgaggagctggaggggacactggcccagggagagctgaatgagatgaggacccgcctctatctcaacctgggcctcacctttgagagcctgcagcagacagccctgtgcaacgattacttcaggaagagcatcttccttgcggagcagaaccacctttacgaggacctattccgcgcccgctacaacctgggcaccatccactggcgcgcgggccagcactcccaggctatgcgctgcttggagggtgcccgggagtgtgcgcacaccatgaggaagcggttcatggagagcgagtgctgcgtggttattgcacaggtcctccaagacctgggagactttttggctgccaagcgagccctgaagaaggcgctacaggctgggctcccagaagcctgtgcagagggcagccatctgtcagaacctccagcatgtgctggcagtggtccggctgcagcaacagctggaagaggctgagggcagagaccctcagggtgccatggtcatctgtgagcagctaggggacctcttctccaaggcaggagactttcccagggcagctgaggcttaccagaagcagctgcgttttgctgagctgctggacagaccgggtgctgagcgggccatcatccacgtgtccctggccaccacactgggagacatgaaggaccaccatggggccgtgcgccactatgaggaggaactgaggctgcgcagcggcaacgtgctggaggaggccaagacctggctgaacattgcactgtcccgcgaggaggccggcgatgcctacgagctgctggccccgtgcttccagaaagcgctcagctgtgcccagcaggcccagcgtccccagctgcagaggcaggtcttgcagcatctccataccgtgcagctgaggctgcagccccaggaggcccctgagaccgaaaccagactgcgggagctcagtgtagctgaagatgaagatgaggaggaggaggcggaggaggcggcagccacagcggagagcgaagccctggaggccggcgaggtggagctctcagagagcgaggacgacaccgatggcctgaccccgcagctggaggaggacgaggagcttcagggccacctgggccggcggaaggggagcaagtggaaccggcgaaacgacatgggggagaccctgctgcaccgagcctgcatcgagggccagctgcgccgcgtccaggaccttgtgaggcagggccacccccttaaccctcgggactactgtggctggacacctctgcacgaggcctgcaactacgggcatctagaaattgtccgcttcctgctggaccacggggccgcagtggacgacccaggtggccagggctgcgaaggcatcacccccctccacgatgccctcaactgtggccacttcgaggtggctgagctgctgcttgaacggggggcgtccgtcaccctccgcactcgaaagggcctcagcccgctggagacgctgcagcagtgggtgaagctgtaccgcagggacctggacctggagacgcggcagaaggccagggccatggagatgctgctccaggcggctgcctcgggccaagatccccacagctcccaggccttccacaccccaagcagccttctgtttgaccccgagacctctcctcctttgagcccctgcccagaacccccctctaatagcactagactcccagaggcctctcaggcccatgtcagggtctccccagggcaggcggcaccagccatggccaggcctcggaggagcaggcatgggccagccagcagcagcagcagctcagaaggcgaggacagcgcaggccccgcacggccgtcccagaagaggcctcggtgctcggccacagcacaacgggtggcagcctggacgcctggccccgccagcaacagggaagcagccacagccagcaccagccgggcagcctaccaggcagccatccggggtgtgggcagtgctcagagccggctggggcctggcccaccgcggggccacagcaaagcccttgccccccaggcagcgctcatcccggaggaggagtgcctggctggggactggctggagctggacatgcccctgacccgcagccgccggccccgcccccggggcactggagacaaccgcaggcccagtagtacctctgggtcggacagtgaggagagcaggccccgtgcccgagccaagcaggtccgcctgacctgcatgcagagttgcagtgcgccagttaacgcagggcccagcagcctggcttcagaacctccagggagccccagcacccccagggtctcagagcccagtggggacagctctgcggcaggccagcccttgggtccggccccgccccctcccatccgggttcgagttcaagttcaggatcatctcttcctcatccctgtcccacacagcagtgacacccactctgtggcctggctggccgagcaggcggcccagcgctactaccagacctgcgggctgctgcccaggctcaccctacggaaagagggggccctgctggccccacaggacctcatccctgatgtgctgcagagcaatgacgaggtgttggctgaggtgacttcgtgggacctgcccccnttgactgaccgctaccgcagggcctgccagagcctggggcaaggggagcaccaacaggtgctgcaggccgtggagctccagggcttgggcctctcgttcagcgcctgctccctggccctggaccaggcccagcttacacccctgctgcgggccctcaagctgcacacagcactccgggagctgcgcctggcagggaaccggctgggggacaagtgtgtggctgagctggtggctgccctgggcaccatgcccagcctggccctccttgacctctcctccaatcacctgggtcccgaaggcctgcgccagcttgccatggggctcccaggccaagccaccttgcagagtttggaggagctggacttaagcatgaaccccctgggggacggctgtggccagtccctggcctccctcctgcacgcctgccccttactcagcaccctgcgcctgcaggcgtgtggcttcggccccagcttctttctgagccaccagacagcactgggtagtgctttccaagatgctgagcacctgaagaccctgtccctgtcctacaacgccctgggagcccctgccctggccaggaccctgcagagcctgcccgccggcaccctcctgcacttagagctcagctccgtggcagccggcaagggtgattcggacctcatggagcctgtattccgatacctggccaaggaaggctgtgctctagcccacctgaccctgtctgcaaaccacctgggggacaaggctgttagagacctgtgcagatgtctctctctgtgcccctcactcatctcactggatctgtctgccaaccctgagatcagctgtgccagcttggaagagctcctgtccaccctccaaaagcggccccaaggccttagcttccttggcctgtcaggctgcgccgtccagggtcccctgggcctgggcctgtgggacaagatagccgcgcagctccgggaactgcagctgtgcagcagacgcctctgcgctgaggacagggacgccctgcgccagctgcagcccagtcggccgggccccggcgagtgcacgctggaccacggctccaagctcttctttcggcgcctctgaccctggcgctgcctttccccaccctcaccgaagcccctaataaatgaagctgctggccgggcgcggtggctcacgcctgtaatcccaacactttgggaggcccaggcgggcggatcacgaggtcaggagatcgagaccatcctggctaacatggtgaaaccccgtctctactaaaaataccaaaaattagccgggcgtggtggtggaagcctgtagtcccagctactccggaggctgaggcaggagaatggcgtgaacccgggaggcggagcttgcagtgagccgagatcgcaccactgcactccagcctgggcgacagaccgagactccgtctcaaaaaaaaaaaaaaataaaataaatgaagctg

SEQ ID NO: 287255 - DNA, 2160 bp, Homo sapiens
aattcgcgtactagccggacttggattttctggaaagatttcagttgaggaacgggaacaaagattatgatagctttccgaccaccaccaacttcaatttccttagctgccgtaatatcagctccctgagctgagccttgaggtccgagttcatctccagctccagaagagcctgggagatgccggactcgaactcgtccgcttctcgccattgggcttcacgatcttggcgctcgaactgaacatggcttctcctttgagaagagcttggctattgtggatgaggagctggaggggacactggcccagggagagctgaatgagatgaggacccgcctctatctcaacctgggcctcacctttgagagcctgcagcagacagccctgtgcaacgattacttcaggaagagcatcttccttgcggagcagaaccacctttacgaggacctattccgcgcccgctacaacctgggcaccatccactggcgcgcgggccagcactcccaggctatgcgctgcttggagggtgcccgggagtgtgcgcacaccatgaggaagcggttcatggagagcgagtgctgcgtggttattgcacaggtcctccaagacctgggagactttttggctgccaagcgagccctgaagaaggcgctacaggctgggctcccagaagcctgtgcagagggcagccatctgtcagaacctccagcatgtgctggcagtggtccggctgcagcaacagctggaagaggctgagggcagagaccctcagggtgccatggtcatctgtgagcagctaggggacctcttctccaaggcaggagactttcccagggcagctgaggcttaccagaagcagctgcgttttgctgagctgctggacagaccgggtgctgagcgggccatcatccacgtgtccctggccaccacactgggagacatgaaggaccaccatggggccgtgcgccactatgaggaggaactgaggctgcgcagcggcaacgtgctggaggaggccaagacctggctgaacattgcactgtcccgcgaggaggccggcgatgcctacgagctgctggccccgtgcttccagaaagcgctcagctgtgcccagcaggcccagcgtccccagctgcagaggcaggtcttgcagcatctccataccgtgcagctgaggctgcagccccaggaggcccctgagaccgaaaccagactgcgggagctcagtgtagctgaagatgaagatgaggaggaggaggcggaggaggcggcagccacagcggagagcgaagccctggaggccggcgaggtggagctctcagagagcgaggacgacaccgatggcctgaccccgcagctggaggaggacgaggagcttcagggccacctgggccggcggaaggggagcaagtggaaccggcgaaacgacatgggggagaccctgctgcaccgagcctgcatcgagggccagctgcgccgcgtccaggaccttgtgaggcagggccacccccttaaccctcgggactactgtggctggacacctctgcacgaggcctgcaactacgggcatctagaaattgtccgcttcctgctggaccacggggccgcagtggacgacccaggtggccagggctgcgaaggcatcacccccctccacgatgccctcaactgtggccacttcgaggtggctgagctgctgcttgaacggggggcgtccgtcaccctccgcactcgaaagggcctcagcccgctggagacgctgcagcagtgggtgaagctgtaccgcagggacctggacctggagacgcggcagaaggccagggccatggagatgctgctccaggcggctgcctcgggccaagatccccacagctcccaggccttccacaccccaagcagccttctgtttgaccccgagacctctcctcctttgagcccctgcccagaacccccctctaatagcactagactcccagaggcctctcaggcccatgtcagggtctccccagggcaggcggcaccagccatggccaggcctcggaggagcaggcatgggccagccagcagctcgcccctgagttagcagctcgcccctgagttagcagctcgcccctgagttagcagctcggccctgagttgtgtatcctctagagtcagctc

SEQ ID NO: 287256 - DNA, 1182 bp, Homo sapiens
  misc_feature (1134)..(1134): n is a, c, g, or t
ttgaccagctgggcttttatttcgcagccaccatcttcattggcaaactggagacagtagttgtacccctagcctcccagggtgggagaggagatggcacgcgtggtccaggagtgctgatggcagagaccaccattggaggttggcagccgtcagccctcactttgagccaggcaccatccatgttgtgttgtttttttttcttgagatggagtctcgctctgtcacccaggctggagtgagacccttggtggacacgtggggcgaagagtcagtcctggcggggcatcgggagctgggcttacgtctcctggtctgcagaaattgtccgcttcctgctggaccacggggccgcagtggacgacccaggtggccagggctgcgaaggcatcacccccctccacgatgccctcaactgtggccacttcgaggtggctgagctgctgcttgaacggggggcgtccgtcaccctccgcactcgaaagctacatgagcggcgacgccctttcccggctcttcctcggctggggcgccccagggcttcggcgcgggcggccttccctcacttctgctcttctcccatccccggtagcaccgtccactcccagttagccggctcagcgctgctctcccgggcctctccaccgagagcttcctgcgcctgcccgccaggcccgctcctcctcccctctccgtctgagtttatcttactgcccggcccattgggccaaaaacaggggtgtcgttcgtaactcctttattttaatcctatctcaaatccctcggcggatctgacggctccactttcaaagagagaacgtctggagctggcccagcttccgtgctaggcaggaccctcccacgggccccgctcccattgtttctccacagctcgctgcccaactaggggcacctctccatcttcattccctaggaccccctctttcgagaagctgcaccttcagcttgttggttcctccaagttcatgcctacttaaaggcgggctgttaagtgtgttgtttcctgtgccccaaactctcctcgtgggccatcaaacagctgcctgccgccctcataacctccctcaacctccagcctgggtgaaagctatatgaccaggcatggtggctcanacctgtattcccaaaactacgggaggttgaggtgggaggattgcttga

SEQ ID NO: 287257 - DNA, 1063 bp, Homo sapiens
  misc_feature (1015)..(1015): n is a, c, g, or t
ggcccggccggtgggcggggaaggggcagagtggggagaggcgactcagggcctggcaccctctgggcgcgcctaggccccggcacagcttcggctgagcgccgcaaaagtcacgttattggcatgttctagaaactggctttccttgctcgttgtccactctgcgaggttgttttgcacatttgcttgtggccgcagaacgtccgctttcgctgttaggcagaagctcctgcgtggttggggcggttggctcctcggcgctctcctgcctggcggctccgtgacggctgccgagcagcctcggtccccaccccgcggctcgcaatggcctcgaccctcggagagcttgacccagacgttccctacctacatgagcggcgacgccctttcccggctcttcctcggctggggcgccccagggcttcggcgcgggcggccttccctcacttctgctcttctcccatccccggtagcaccgtccactcccagttagccggctcagcgctgctctcccgggcctctccaccgagagcttcctgcgcctgcccgccaggcccgctcctcctcccctctccgtctgagtttatcttactgcccggcccattgggccaaaaacaggggtgtcgttcgtaactcctttattttaatcctatctcaaatccctcggcggatctgacggctccactttcaaagagagaacgtctggagctggcccagcttccgtgctaggcaggaccctcccacgggccccgctcccattgtttctccacagctcgctgcccaactaggggcacctctccatcttcattccctaggaccccctctttcgagaagctgcaccttcagcttgttggttcctccaagttcatgcctacttaaaggcgggctgttaagtgtgttgtttcctgtgccccaaactctcctcgtgggccatcaaacagctgcctgccgccctcataacctccctcaacctccagcctgggtgaaagctatatgaccaggcatggtggctcanacctgtattcccaaaactacgggaggttgaggtgggaggattgcttga

SEQ ID NO: 287258 - DNA, 436 bp, Homo sapiens
catccaatctttgcaatattttgcaataggaacatcatgcgcacggatgatcaaaggaaattgtccttttcacctaaatttttgaatatcttggcatgagagcccaagtagagtgcagaatcacctgggttcagacgattctcgtgcctcagcctccggagcagctgggattacaggtaatttacatcgactgcatctgtatggtgaaaatatagtataatggggtgctgctgtgaatctccttccaattctgcattctgtgatatcatagtggtaacctgaaatccaccatagtggggacatttacacaataactggcaaatgctacaaggctgggctttttcagttttgttgattgtctggacataaaaaggtaatacagaaaatgttaccaatacaagcatttgggaaaaataaactaaaaccttttgtgaaa

SEQ ID NO: 287259 - DNA, 430 bp, Homo sapiens
tggtctggatcaagacaatgtggagatctggtgtggaggctgtggccaggcttcctcccaccagtctctgacaatatttcctctgcctgcctctggagctaccaccatgaaaagaagggcttccggctctgaaagctctgtgtgtaggactcgctagaagaccgctggtgggaacgggccgtctcgacaatcacaggtggcatctggacgaggtgcaggggactcttgttgtctttcaaggcctgggtcagatttaagatctgcagtgggaaaaaggagatgggtgagggagaggcctcagcattccagatctgcctctgaaaggagatcagtagagaggacgcctacaaatcaattttttaaaataccaatggaaaatcatgcaaataggccatttacaaaagtaaaaattagcaaaacagaaaatgga

SEQ ID NO: 287260 - DNA, 715 bp, Homo sapiens
cattaggatccactgagagttggttagctgtgattaatactgtcatctgtgaccatgaaaatctatagtggtttgccccattacatatctgaaacattgtcttatgaaaacaaaatgaaacaaaattaaataaaattgaagataaaaatactctggaagcacaggatatctgacaagaatcttcagcacaaagcacatgtttgaaaacgtgaaacgatgactctttggaggacaatagctaaatatccaagaatcatcagtaaagaaaacaaaacgcagcacattcacattttcccgaggaactgtaaagatgatctctacagggataaacgttgtaaagcctgaagctcaatcaactgatgttggaaactctcaaagggagtaaaggcttgatctcaatggtctagaacatgtactgtaatttaatagaagagatggtcgtcttaatatttaatgatttaaaagaacttcccagtccatgcgaagagtacagtccaagaataaatcaaatttctgaacgcattttatgctacatatgtgtatactttgcgatcctcaggtgttcgtgccaaatattctctctcaataagtccttcaatacgtttcttaataacaactggacttggtaagaatcgcgccttcaactgctgagttacctaaaaaagaaagtagatagtatttttatataaacacataaaaattcgtatctttgaac

SEQ ID NO: 287261 - DNA, 1136 bp, Homo sapiens
aggacgagcaggacacgcagccctggggacgaggacaaaggaacccagaacccgagctgggtagggcgggcaggctgggtctgtcacccagagggacacaagcttccatcccctctggtcagagctgagaagaggaaggcaggggaggaggccagaggccccgtcaaggccccgtccaggatggggggctacacccactagggttacgcatgtctgatggcaccaacctatgaagcggtctttccagagaagtggaaaacacaaacaggatcatgaagaagatgtcacgacaccactaacgcaaacctgaaaactcgcgtgaactaaacaatgaatgctggccgggtgcggtggctcatgcctgcaatcccagcactttggcttcagaaaacatggaaaacacagaaaagtataaagaaaaaaagacacccatatgaatcttaccactcaaagttaccacaaacagaagtcttgttctcattgtaattattcaagccatccacatttactataaaaatactgggcgaaaaggctttagagaaagagggaagagcaagtatgggatatgcacagggtctcaggttcatgaggaaaacaaattttttgaattttgaattgggtaaatgaaattcaaaattaagtggcatcaagaattcagttggggccgggcgtagtagctcacgcctgtcatcctagcacttttgagaggccaaggcgggtggatcacctgaggtcaggagttccagaccagcctggccaacgtggtgaaaccccgtctctcctagaaatacaaaaattagccaggcgtggtgacgtgcgcctgtaatcccagctactcaggtggctgaggcaggagaatcgcttgaacctgggaggcggaggtttcagtgagctgagatcacacccctgcactccagcccgggcaacagagtgagactccgttgcaaaaaaacaaaaacgaaaacgaaaacaaacaaaccaagaattcagttggatacattaactatgtaaaaaggaaaaaaaaggccgggcgtggtggctcacgcctgtaatcccagcactttggaaggccgaggagggtggatcatgaggtcaggagatccagaccatcctggctaacacggtgaaaccccgtc

SEQ ID NO: 287262 - DNA, 859 bp, Homo sapiens
cacagtggctctcgcctgtagtcccagcactttgggaggccaaggcaggaggatcacttgaggtcaggagttcaaggccagcctggccaacatggtgaaacccccttcagaaaacatggaaaacacagaaaagtataaagaaaaaaagacacccatatgaatcttaccactcaaagttaccacaaacagaagtcttgttctcattgtaattattcaagccatccacatttactataaaaatactgggcgaaaaggctttagagaaagagggaagagcaagtatgggatatgcacagggtctcaggttcatgaggaaaacaaattttttgaattttgaattgggtaaatgaaattcaaaattaagtggcatcaagaattcagttggggccgggcgtagtagctcacgcctgtcatcctagcacttttgagaggccaaggcgggtggatcacctgaggtcaggagttccagaccagcctggccaacgtggtgaaaccccgtctctcctagaaatacaaaaattagccaggcgtggtgacgtgcgcctgtaatcccagctactcaggtggctgaggcaggagaatcgcttgaacctgggaggcggaggtttcagtgagctgagatcacacccctgcactccagcccgggcaacagagtgagactccgttgcaaaaaaacaaaaacgaaaacgaaaacaaacaaaccaagaattcagttggatacattaactatgtaaaaaggaaaaaaaaggccgggcgtggtggctcacgcctgtaatcccagcactttggaaggccgaggagggtggatcatgaggtcaggagatccagaccatcctggctaacacggtgaaaccccgtc

SEQ ID NO: 287263 - DNA, 472 bp, Homo sapiens
aagaattcttatcttctagaaattttggttgaaatatttatagacaaagtaagatgacatctgtgatttgcttctaaagaactggggcgagggggaaaggtgaatgggggtgaagataaaacaagcctggccacaagatgatagctgctgaagccggccacagccatgtggaagcttgttactctatgtctatgtttgaaattgtccatgataaaaagtatgtatttaaaaaagcagctgggcatggtggctcatgcctgtaatcccaacactttaggaggccaaggtgggaggatcgtttgagagcaggagttccagactaacctgggcaacatggttgagaccctgtctctacaaaattaaaaaataattttaaaaagtaaccacattcacttcagaaaacatggaaaacacagaaaagtataaagaaaaaaagacacccatatgaatcttaccactcaaagttaccaca

SEQ ID NO: 287264 - DNA, 2045 bp, Homo sapiens
tttgagacagactctcactgtattgcccaagctggagtgcagtggtgcgatctcggcttctcttaactactcagagtaaaatgtgagaagaaacaatacaaagatgggatttataacacggaagcaaaatatagagatttgaaaattctcagcctaagcatgtaaataaaaaggtatttaggaaagtaaaccaagggtgtgaccaagtgactttctgatcagagtgtggctagaaagaagccaggtgttttcatcatgacaataggagaatgaacccaatggcacttcagagagcttcaaggccgctcctcccatcacaggcccacagtgcgagggccttgaaggcaggatggtttccagggaagggcgtagaacactcatggaactttggggcttgctgcccggggctgcctcaagtctctgctccccacatcccggcacagtgctccttggctgccgtagttgtggctccagtgggcccaggtgcagtttagtccctgctctggagggcaaagtggtgaacctcagcatccacatggtactgattttgcaagtgtgcagagtgcacaagatgtggaagcatggcatccttcaaagagatttctttttttttttttttgagacagactctcactgtattgcccaagctggagtgcagtggtgcgatctcggcccaccgcaacctccgccttattccattattattccattgtagcttggaagcacgtaactagtttggtttcacaggtacaggactagagagcaatttgcctcaggatgaatcacatgatttagataatacctagatgagactctgccctttaagttgactttaaagtttatgctgaaatgagttttaatactttgggggctattggagtgaaatgaatgtattttgtacatgagaaagacatgaatatagggggggtccaggggcagaatgtaacatgtcctctccaaaattcaggtgttgccaatgtgatagtattagaaggtggagcctggccgggcgcggtggctcatgcctgtaatcctagcactttgggaggccgaggtgggcggatcacgaggtcaggaaatcgagaccatcctggctaacagggtgaaaccccgtctctactaaaaaactacaaaaaaatagccgggcgtggtggcaggtgcctgtagtcccagctactcaggaggctgaggcaggagaatggcaggaacctgggaggcggagcttgcagtgagctgagattgtgccctccagcctgggcgacagagcaacactctgtctccagaaaaaaaaaaaaaaaaagaaggtggagcctttaagaggtgatgaggggctcctccctttgtgaatgggattacagccttcataaaagaggctcaatgcagacttccttgtcctcccttttgcacgtgaggacacacgtcctttctggaggatgcagcatcaaggcacccttggaagaggacatttgaacctgatgatgccttgatcttggacttcataaactacagaactgtgatacatttctgttctttataaatcaggtattttgttatagcagcacaaacagactaagaaagttgcctatgggtgccaggcgcggtggctcacgcctgtaatcccagcactttgggagggtgaggcaggtggatcatgaggtcaggagttcgagaccagtctggccaacatagtgaaaccctgtctatactaaaaatacaccaaaaattagccaggcatggtggtgtgcgcctctaatcctagctactcgggaggctgaggcaggaaaatcgcgtgaacccaggaggcggaggttgcagtaaaccgagatcacaccacagcactccagcctgggcaacagaatgagattgtgtctcaaaaaaaaaaaaaagttgtctatgggtgactcagctgcaaagctgcaaggagattgagagtaagacgatggaaaaaacggtcaagccgagaaccaaatcaggaacacaatcccatttacaattgccactaaaagaataacatacctaagaatacagctaaccagggaggtgaa

SEQ ID NO: 287265 - DNA, 790 bp, Homo sapiens
ctcggcacgacccaggttccatgctacaggcctctacttgtccagacctgagggtcagattcagatggtgcaaatgtttaagacctgggtcttcaacgagatgaattatcagctatttcatagctgcagtgttggatatgccgagacgataaaagcaacagcaatcagaatcaacagttgaaacgacatggcagacgctgtgaatgctatgaactgctgtgctgagcagcaggattcctgtgtcctggcgcaatgcccatggggattcatgctttcagagggtcacgccttaggaacacgtagaagggcaagcatttcatctggcagggcactgatttaatctgcacgcatgtttggctgtaaaactagctcctcccccttaccatttttgagtcgctgccggactcaaattccacagattctggaaggtgtccaggaactcgttgatttgtcaaacttatggctacacacagctggaatggagacggactccactgaggagactcatacaggacaggagggaattttaagaggataaccctgagattgaaaacatcaaaccaaacctgaagcactgagaggttgggtaaccagctctggtcactgagttggtgagggatggattcagaagaggtctccaattgtgacaccgcagaggacctgctcttggccactacactctaccagctctgcaagaagcgcttccacacttttcatctcagacccacagagccagtgtgtgcggctgaggtgctcagactggcaggtgaaatgacttcattagtgccct

SEQ ID NO: 287266 - DNA, 329 bp, Homo sapiens
aaagagggaagacagcacttgaaaggaaagagggtaaagaagaggaagggaggttacaattgagagcactgcagaaggaagcgatgcagatgttgccgcccggctctggcagtccgaaggagcaaccccacgcatagaaaaaaacagattctacttggttctagctgaagtattatcaactccaaataacgctttgaggacctccaaagctgctttcctttgcctgcaagaggtgtcaagatgagttttgcctgacttctttgatgtcctgaactttctgtagtccttttttttcttcaatttgttcattataaatttagcttagcatt

SEQ ID NO: 287267 - DNA, 759 bp, Homo sapiens
caggccatggagaaccatgagaaagctttaaatggggatgtaaaatatgatctgtggaagggagagagcagcatgctggaggggatgatttggcaagtccgctgaagaacacaagcctcgactgctccccggcgtggaagaaggaaggcgataaatactgtaacggaggacgaggaaggagcactgagttctatgtggaaagaaagggtcaaaaagaggaaaacgcctattcacatgcatggcgtttaacagatttattaggttgtttgctgtgtgatgtaaatctcctcctctctctccttgaaatttcttgagtgaattctacattgttcattcattcatgtttatgtgccagcaagctttgggagcactgtaaaaataaaaaaggttagaccactgttagacatctgggaaacatctatgttagagaaggactatatattaatttatctcatttatgggaggcaaatactatgattattgaaggtacatctctttctttatggatggagtacatcttatttttctaaaatttgtatttgaacctatttatttctaattgtcaaaaatgtgaagtgagaaacttaaaaactttttagtttctcttgtcccaccattttatgtacttccaggttgtcaaataatttggaattttagacttagataattctctaatgtatattatagatcttctatttcaataattagcttatattttaattaaattgtataactgcattaaaatatacttaactatgt

SEQ ID NO: 287268 - DNA, 3220 bp, Homo sapiens
tcatctcgggccgctcgcgcgctccgagtccgggtctggtggggcggtgcagagcgggattcccgaggcagggtcgtgggcactctatcgcggcgggcggttgaaggcgttacagtccttggaaaccgagctgctagccggttgctaggagcgtccagtgtctggagtgggaggaacaaaacgcctcacgtcacaaggcgaggaatcgagcgccgagagagcgagtcggtgctactggcgccgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaatattttaactaaagcctttattctat

SEQ ID NO: 287269 - DNA, 3461 bp, Homo sapiens
tcatctcgggccgctcgcgcgctccgagtccgggtctggtggggcggtgcagagcgggattcccgaggcagggtcgtgggcactctatcgcggcgggcggttgaaggcgttacagtccttggaaaccgagctgctagccggttgctaggagcgtccagtgtctggagtgggaggaacaaaacgcctcacgtcacaaggcgaggaatcgagcgccgagagagcgagtcggtgctactggcgccgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcaggtacttcgtggggttggagggctgcagggccaggtgggtggggcctgaccattgggcatggacctcagagttctatggtggagatggaggagggttgccctgggcccagggatcctgaggctgaccggtatttcagaagtacccttttcagcccccttattgctggtagtaggtggggatagcaaaggtagggagggccgtgggacaagcccctggattgaatgtttctggccttcggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaatattttaactaaagcctttattctat

SEQ ID NO: 287270 - DNA, 3179 bp, Homo sapiens
tcatctcgggccgctcgcgcgctccgagtccgggtctggtggggcggtgcagagcgggattcccgaggcagggtcgtgggcactctatcgcggcgggcggttgaaggcgttacagtccttggaaaccgagctgctagccggttgctaggagcgtccagtgtctggagtgggaggaacaaaacgcctcacgtcacaaggcgaggaatcgagcgccgagagagcgagtcggtgctactggcgccgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaatattttaactaaagcctttattctat

SEQ ID NO: 287271 - DNA, 535 bp, Homo sapiens
catagcatatactccaggtgtctagtaggctatgtgtaggttaagttctatgatgtttgcacaacaatgaagtcaactaacaatgcatttctcagaatatatccctgtcattaagcaatgtgactgtaaatatactgttttttctggtatattcttatatgattaatcgatatcttaacctcagtgaccaagctgtcatagatgttagtctgtccacagacacacatgcacacccaacacctgtgcccattgatggtatctaagttcttgaatgctcagtcctgtagcctggtggaaggagggtgctctgaactagaagttggctgatttgttttctagccacttatttttctcattttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaatattttaactaaagcctttattctat

SEQ ID NO: 287272 - DNA, 781 bp, Homo sapiens
tcatctcgggccgctcgcgcgctccgagtccgggtctggtggggcggtgcagagcgggattcccgaggcagggtcgtgggcactctatcgcggcgggcggttgaaggcgttacagtccttggaaaccgagctgctagccggttgctaggagcgtccagtgtctggagtgggaggaacaaaacgcctcacgtcacaaggcgaggaatcgagcgccgagagagcgagtcggtgctactggcgccgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctggtgagttccccaacctgcctctgctttgcttgcttatgtgtgtttgtgtgtcttcatctgtcccacagggggccccagtctacccttccctccctttttttctaaagggagtcccagccctgtctccccttcttccagggctgtactcagagcctgactggggccctgcccagtgctcagcttctgagctctgtggggtggacagaggacatatggcctcttggaggtggcaacaaggcccaaggcctgcctcctggggcatgagggatatgagggccctggccaaggggcagctcagagtggggcagcactggaatgctgtggatctgggaggctt

SEQ ID NO: 287273 - DNA, 429 bp, Homo sapiens
gactctagaggactcccgctctcacccacccccgaggactctccttccctggagacaggttccaggcagagtgactacatggagactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtgtgtggagagcggggggtgggtggagagcgg

SEQ ID NO: 287274 - DNA, 3020 bp, Homo sapiens
tcatctcgggccgctcgcgcgctccgagtccgggtctggtggggcggtgcagagcgggattcccgaggcagggtcgtgggcactctatcgcggcgggcggttgaaggcgttacagtccttggaaaccgagctgctagccggttgctaggagcgtccagtgtctggagtgggaggaacaaaacgcctcacgtcacaaggcgaggaatcgagcgccgagagagcgagtcggtgctactggcgccgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacactgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaatattttaactaaagcctttattctat

SEQ ID NO: 287275 - DNA, 3207 bp, Homo sapiens
ctggccgcgggttgggcaccagcagcgccgcgcccagagtgcgcagctattgttctcgaagtcggatgcgttattctctggtgccggctcgcgcgggcaattggtcgcctccttcctcgggtcgaaagaatgtcacctactatccatgtcgtggactgcacatccgtgcgacttatgcacaacatttgacgcctcgctctgcctgcgggcctgctctcctgtgcctgggctctggcgaagtagaagtctagccatcgccagaggacacgtcccgaggggcctgggggttaactcgaggtgtgacgcagcatgctcggggagccccgttcggcgcgcgtacctgccagttcgtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaatattttaactaaagcctttattctat

SEQ ID NO: 287276 - DNA, 3338 bp, Homo sapiens
tcatctcgggccgctcgcgcgctccgagtccgggtctggtggggcggtgcagagcgggattcccgaggcagggtcgtgggcactctatcgcggcgggcggttgaaggcgttacagtccttggaaaccgagctgctagccggttgctaggagcgtccagtgtctggagtgggaggaacaaaacgcctcacgtcacaaggcgaggaatcgagcgccgagagagcgagtcggtgctactggcgccgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgtgaccctgctgagggctgctgcccactaaggcccttgccccatctcaggcccagacttgtctgagggtcctagcctgggcatgaggtggccttggagtcagccccattgcccccacagaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaatattttaactaaagcctttattctat

SEQ ID NO: 287277 - DNA, 3129 bp, Homo sapiens
tcatctcgggccgctcgcgcgctccgagtccgggtctggtggggcggtgcagagcgggattcccgaggcagggtcgtgggcactctatcgcggcgggcggttgaaggcgttacagtccttggaaaccgagctgctagccggttgctaggagcgtccagtgtctggagtgggaggaacaaaacgcctcacgtcacaaggcgaggaatcgagcgccgagagagcgagtcggtgctactggcgccgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggagcccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaatattttaactaaagcctttattctat

SEQ ID NO: 287278 - DNA, 3092 bp, Homo sapiens
tcatctcgggccgctcgcgcgctccgagtccgggtctggtggggcggtgcagagcgggattcccgaggcagggtcgtgggcactctatcgcggcgggcggttgaaggcgttacagtccttggaaaccgagctgctagccggttgctaggagcgtccagtgtctggagtgggaggaacaaaacgcctcacgtcacaaggcgaggaatcgagcgccgagagagcgagtcggtgctactggcgccgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggatggaggctgaggggctggacagccaggcccagatctctaccacagaataacatcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaatattttaactaaagcctttattctat

SEQ ID NO: 287279 - DNA, 4808 bp, Homo sapiens
tcatctcgggccgctcgcgcgctccgagtccgggtctggtggggcggtgcagagcgggattcccgaggcagggtcgtgggcactctatcgcggcgggcggttgaaggcgttacagtccttggaaaccgagctgctagccggttgctaggagcgtccagtgtctggagtgggaggaacaaaacgcctcacgtcacaaggcgaggaatcgagcgccgagagagcgagtcggtgctactggcgccgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaatattttaactaaagcctttattctatacaactgtgaaatacagatttttacccttttggcattgcagactgtcgaattttctggaaactgtattacggtttgactggaggggaaagaaatacaatcatgctgggggtcagatctatgacaggaggggaatgcagccacccaaggcttagcacacagggcaaaatgacccagcaaaacccatttctttgctcaaaggcccctcgggcaaacacaactgagggctggtaaataattttttttttctttgccattaattcacaactattgctaaaaaatgtgcaccaaaagcacactgttgtatccaacagatagaaaggacttttaaaaaaaaaagaagctggttgctctctgaggaagggagaaagaccatttcaacttattagaaatgtggccacgtctttgctcacttcttcaaagtgcaggtggcaatggcctgtccagtttccaaaagaagctgactagcagtgagggaaccctgtctctgcagttgtgcgatcagagtatcttaaatagtaaggtatggccttaggcctatcagctgcccccagccgaacctgtgaagatgtagaaaagaaaaaacgttccctgcctccctccctagtccctgctatggtggaggcaggccacacacaagctagggaggcaactggactggaatcaactgccctctgaaggcacttgtgcttctggcttcatacaggaggcttgtcttacagttttatgggggtggaccactgatttactctgaatacaaatgaccttggggagaatccaaagtattttctgccaaaagttgaagtgtttatccccaataagttacactctatacaagatccaaatgattctatgaaagtgttagattgttagaacagtgaaaagaagatctggatacaggtacaacaaaaacctgcatataaaactttggaaaaacaaatatgtatacttccaggatatgaatatcaaattaactcactatgatctccctttattctgacaccataaattttaggtaacatttgaatgaaactgaaatttcatcatggtcttaaattttgatggtgtcatgctgctcatccagagcaagaacctgtggtctcagctcgctttgtgtaaataaaactggacacagtggaggaaggagtgaaactgctgcacctccctggggttgccacaaagccaggacatcatgggaggtgcagcatcgctaggcatgggctgcacaaactccggcccaacagtccaagtgctatgatccagcacctggaatttcaacagatcttcctacaagaacacatctgagatgcaatattaacaacaagcccaacattaatcttttattatgaaatgggctggttctcaaattgtgcaacagcaaattcccattaaaaataactgtcttaaacggtgaaaacaatttgattactttatatgacaaacttggaaaaagccttcatatctactgcatgaatggaatgtactgttttagaaaagctacagagtgtgtgggcttaaagttgaaacagagacagttgtggcccgactgaggtgtctctaacaagtgttaatgggtagataaggtccttt

SEQ ID NO: 287280 - DNA, 3356 bp, Homo sapiens
tcatctcgggccgctcgcgcgctccgagtccgggtctggtggggcggtgcagagcgggattcccgaggcagggtcgtgggcactctatcgcggcgggcggttgaaggcgttacagtccttggaaaccgagctgctagccggttgctaggagcgtccagtgtctggagtgggaggaacaaaacgcctcacgtcacaaggcgaggaatcgagcgccgagagagcgagtcggtgctactggcgccgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaatattttaactaaagcctttattctatacaactgtgaaatacagatttttacccttttggcattgcaaaaataaaaaataaaaacaaaaacttcgaggggtggccccagtttccaatttggcctatagtgaagtcgcatccaaatcactggcctataaattac

SEQ ID NO: 287281 - DNA, 3132 bp, Homo sapiens
tcatctcgggccgctcgcgcgctccgagtccgggtctggtggggcggtgcagagcgggattcccgaggcagggtcgtgggcactctatcgcggcgggcggttgaaggcgttacagtccttggaaaccgagctgctagccggttgctaggagcgtccagtgtctggagtgggaggaacaaaacgcctcacgtcacaaggcgaggaatcgagcgccgagagagcgagtcggtgctactggcgccgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaatattttaactaaagcctttattctat

SEQ ID NO: 287282 - DNA, 3236 bp, Homo sapiens
tcatctcgggccgctcgcgcgctccgagtccgggtctggtggggcggtgcagagcgggattcccgaggcagggtcgtgggcactctatcgcggcgggcggttgaaggcgttacagtccttggaaaccgagctgctagccggttgctaggagcgtccagtgtctggagtgggaggaacaaaacgcctcacgtcacaaggcgaggaatcgagcgccgagagagcgagtcggtgctactggcgccgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaacagcactgatgtcaatgaatgtcagaatcaattctactctgggttgtaccagcatcacatccgggtgtacgttctcgtga

SEQ ID NO: 287283 - DNA, 3155 bp, Homo sapiens
tcatctcgggccgctcgcgcgctccgagtccgggtctggtggggcggtgcagagcgggattcccgaggcagggtcgtgggcactctatcgcggcgggcggttgaaggcgttacagtccttggaaaccgagctgctagccggttgctaggagcgtccagtgtctggagtgggaggaacaaaacgcctcacgtcacaaggcgaggaatcgagcgccgagagagcgagtcggtgctactggcgccgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaatattttaactaaagcctttattctat

SEQ ID NO: 287284 - DNA, 3083 bp, Homo sapiens
tcatctcgggccgctcgcgcgctccgagtccgggtctggtggggcggtgcagagcgggattcccgaggcagggtcgtgggcactctatcgcggcgggcggttgaaggcgttacagtccttggaaaccgagctgctagccggttgctaggagcgtccagtgtctggagtgggaggaacaaaacgcctcacgtcacaaggcgaggaatcgagcgccgagagagcgagtcggtgctactggcgccgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcacagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaatattttaactaaagcctttattctat

SEQ ID NO: 287285 - DNA, 1886 bp, Homo sapiens
tcatctcgggccgctcgcgcgctccgagtccgggtctggtggggcggtgcagagcgggattcccgaggcagggtcgtgggcactctatcgcggcgggcggttgaaggcgttacagtccttggaaaccgagctgctagccggttgctaggagcgtccagtgtctggagtgggaggaacaaaacgcctcacgtcacaaggcgaggaatcgagcgccgagagagcgagtcggtgctactggcgccgggtcggtccgggtaggcgcagcgggactggacctgggtgccgagcggagccgctgccatgggcctgggcgtcagcgctgagcagcccgcaggcggcgccgagggcttccacctccacggggtgcaggagaactccccagcccagcaggcgggcctggagccctactttgacttcatcatcaccattgggcactcgaggctgaacaaggagaatgacaccctgaaggcactactgaaagccaatgtggagaagcccgtgaagctggaggtgttcaatatgaagaccatgagggtgcgcgaggtggaggtggtgcccagcaacatgtggggcggccagggcctactgggtgccagtgtgcgcttctgcagcttccgcagggccagtgagcaggtgtggcatgtgctggatgtggaaccatcttcacctgctgcccttgccggcctgcgcccctacacagactatgtggttggttcggaccagattctccaggagtccgaggacttctttacgctcatcgagtctcatgaggggaagcccttgaagctgatggtgtataactccaagtcagactcctgccgggaggtgactgtaactcccaacgcagcctggggtggagagggcagtctgggatgtggcattggctatgggtatctacaccggatcccaactcagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagaggggagcccagtgtcaagtctgctggaatgcaggaagtagaacagaatcgccacaggactgttctggggccagcttcccttaactctgtagcctggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttgaaatattttaactaaagcctttattctat

SEQ ID NO: 287286 - DNA, 535 bp, Homo sapiens
gttttttctggtatattcttatatgattaatcgatatcttaacctcagtgaccaagctgtcatagatgttagtctgtccacagacacacatgcacacccaacacctgtgcccattgatggtatctaagttcttgaatgctcagtcctgtagcctggtggaaggagggtgctctgaactagaagttggctgatttgttttctagccacttatttttctcactgacttcttgggagagcctggccaagtttctcaactttcacagcctgccttaatctgcccatgagggaaaggggactgatgatgcaaattgctttgcatttcccagggagactgggagattgggagtggtggaactttccaagggagaagggaatccttatttgtacccagttttgctcattgccctcacctccaacccctaggagtctttagccacatgcctgcagcagaagcagcaatgtagtgggtgctcctgtagccaaggtgtgcttttcttcttttcatatatttatttatttttctcagcaaccctat

SEQ ID NO: 287287 - DNA, 1766 bp, Homo sapiens
ggccgtaggcggggcgggcggcggcggcggcggcggagccaggacccagacatctgggactgttgttctctcgcggcgcgaccgcctcagtcacttcgcccagagacccggacctggtccgctggggagcaggcggccataaaccccctctctcccggttccctgacgccgcggcaggagctgttacaaacaccctgcggttggtctccgatgcccttcagtgaggtggggacgcctggaccctggtgagcgaaccccaagccaccccccaccccaactcagtgtcttcgccggcccccggcccgtacgcctgtctggtcgccatggctgaaaacacagagggggatctgaactccaacctgctccacgccccctaccacaccggggaccctcagctggacacggccatcgggcagtggctccgctgggataagaatcccaaaacaaaagagcagattgaaaacctgttacggaatgggatgaacaaggagctgcgagatcgtctttgttgccgaatgacttttgggactgcaggacttcgttctgccatgggggcagggttttgctatattaatgaccttacagtaatacagtcaacacaggggatgtacaaataccttgagagatgtttctcagacttcaagcagagaggctttgtggttgggtatgacactcggggtcaagtaactagcagctgcagcagccagaggcttgctaaactcactgctgcagtcttgctggccaaagatgttcctgtgtaccttttttcaagatatgttcctacaccttttgtaccatatgcagttcagaagctcaaagcagttgcaggtgtgatgattactgcctctcacaaccgcaaggaagacaatggatacaaggtttactgggaaactggtgctcagatcacatctcctcatgataaagaaattctaaaatgtatagaagaatgtgtggaaccctggaatggttcctggaatgataatttagtggataccagcccgctgaagagagaccctctgcaggacatttgcaggagatacatggaagatctgaaaaagatctgtttttacagagggagttaaactcgaagaccaccttgaaatttgtgcacacatcttttcatggggtcggacatgactatgtgcagttggcttttaaagtgtttggttttaagcctccaattccagtaccagaacaaaaagatcctgatccagacttttctaccgttaaatgtccaaatcctgaagaaggagaatctgtgctggaactttccttgagactggcagagaaagaaaatgcccgggtagtgctagccacagatcctgatgcagacagactggcagcagcagaacttcaggagaatggttgttggaaagttttcacagggaatgagttggcagctttgtttggatggtggatgtttgattgctggaagaaaaataaatcaagaaatgctgatgtgaagaacgtttatatgttagccaccacagtctcttctaaaattctgaaggcaattgcacttaaagaaggatttcattttgaagaaacattaccaggttttaaatggattggaagtaggataatagacctcctggaaaatgggaaagaagtcctttttgcatttgaagagtctattggttttctctgtggaacttcagttttggataaagatgggggtgagtgcagctgttgtggttgctgagatggcatcttacctggaaaccatgaatataacattgaaacagcaactggttaaggtttatgaa

SEQ ID NO: 287288 - DNA, 644 bp, Homo sapiens
cgcgaccgcctcagtcacttcgcccagagacccggacctggtccgctggggagcaggcggccataaaccccctctctcccggttccctgacgccgcggcaggagctgttacaaacaccctgcggttggtctccgatgcccttcagtgaggtggggacgcctggaccctggtgagcgaaccccaagccaccccccaccccaactcagtgtcttcgccggcccccggcccgtacgcctgtctggtcgccatggctgaaaacacagagggggatctgaactccaacctgctccacgccccctaccacaccggggaccctcagctggacacggccatcgggcagtggctccgctgggataaggtgggtacctggtcagcccggcaaacgccgtcgcctcccccacacagtctgctctttcctgtgcccacccagcgccccgcgggctgcagaggagatggctcgggacaccgagcggggggcagcggagcagggcgttgccacccacctatgcgtggggttgctccttcggactgccagagccgggcggcaacatctgcatcgcttccttctgcagtgctctcaattgtaacctcccttcctcttctttaccctctttcctttcaagtgctgtcttccctctttcttc

SEQ ID NO: 287289 - DNA, 951 bp, Homo sapiens
tcgccctccgctgcgccctccccgagcgcggctccaggaccccgtcgacccggagcgctgtcctcgtggaccgagtcgcgggcctgggcacggaactcacgctcactcccagctcccgacgtgcacacggctcccatccgttgtcttccgagcgtcaggccgcccctacccgtgctttctgctctgcagaccctcttcctagacctccgtcctttgtcccatcgctgccttcccctcaagctcagggccaagctgtccgccaacctcggctcctccgggcagccctcgcccggggtgcgccccggggcaggacccccagcccacgcccagggcccgcccctgccctccagccctacgccttgacccgctttcctgcgtctctcagcctacctgaccttgtctttacctctgtgggcagctcccttgtgatctgcttagttcccacccccctttaagaattcaatagagaagccagacgcaaaactacagatatcgtatgagtccagttttgtgaagtgcctagaatagtcaaaattcacagagacagaagcagtggtcgccaggaatggggaagcaaggcggagttgggcagctcgtgttcaatggttttgtccgccttccctgcctcctcttctgggggagttagatcgagttgtaacaagaacatgccactgtctcgctggctgcagcgtgtggtccccttaccagagtgaggatgcgaagagaaggtggctgtctgcaaaccaggaagagagccctcaccaggaacccgtccagctgccaccttgaacttggacttccaagcctccagaactgtgagggatcaactgaattcctatcggggtgatcactaagaagaaaaggtgaataccggatgttggaagctattgaatctgccaccagtgaaattctttcacaccattctgctgtcctgggtccttgaacccaaat

SEQ ID NO: 287290 - DNA, 267 bp, Homo sapiens
taacactctctccctctcccagttttgtccgccttccctgcctcctcttctgggggagttagatcgagttgtaacaagaacatgccactgtctcgctggctgcagcgtgtggtccccttaccagagtgaggatgcgaagagaaggtggctgtctgcaaaccaggaagagagccctcaccaggaacccgtccagctgccaccttgaacttggacttccaagcctccagaactgtgagggataaatgtatgattttaaagtcgcccagt

SEQ ID NO: 287291 - DNA, 267 bp, Homo sapiens
gggcctttggtaggtaattacggttagatgaggtcatggggtggggccctcattatagatctggtaagaaaagagagcattgtctctgtgtctccctctctctctctctctctctctctctcatttctctctatctcatttctctctctctctctatctcatttttctctctctctctttctctcctctgtcttttcccaccaagtgaggatgcgaagagaaggtggctgtctgcaaaccaggaagagagccctcaccaggaacccg

SEQ ID NO: 287292 - DNA, 865 bp, Homo sapiens
tcgccctccgctgcgccctccccgagcgcggctccaggaccccgtcgacccggagcgctgtcctcgtggaccgagtcgcgggcctgggcacggaactcacgctcactcccagctcccgacgtgcacacggctcccatccgttgtcttccgagcgtcaggccgcccctacccgtgctttctgctctgcagaccctcttcctagacctccgtcctttgtcccatcgctgccttcccctcaagctcagggccaagctgtccgccaacctcggctcctccgggcagccctcgcccggggtgcgccccggggcaggacccccagcccacgcccagggcccgcccctgccctccagccctacgccttgacccgctttcctgcgtctctcagcctacctgaccttgtctttacctctgtgggcagctcccttgtgatctgcttagttcccacccccctttaagaattcaatagagaagccagacgcaaaactacagatatcgtatgagtccagttttgtgaagtgcctagaatagtcaaaattcacagagacagaagcagtggtcgccaggaatggggaagcaaggcggagttgggcagctcgtgttcaatgggtagagtttcaggctggggtgatggaagggtgctggaaatgagtggtagtgatggcggcacaacagtgtgaatctacttaatcccactgaactgtatgctgaaaaatggtttagacggtgaattttaggttatgtatgttttaccacaatttttaaaaagctagtgaaaagctggtaaaaagaaagaaaagaggcttttttaaaaagttaaatatataaaaagagcatcatcagtccaaagtccagcagttgtccctcc

SEQ ID NO: 287293 - DNA, 4287 bp, Homo sapiens
aagaaaaaattaattaagatgtatttaacctttaagtatagaatgattgtataaattagatttcaactgaaaggacaattagcgattcagagaaagctcctagaaatagactgaaaacaaagccatacatagagtaagaaatagaacctatggaacttccatttttctaactatagttttttgtttttgttttttcccagttgttaaaaaaaaaacaactcacagtttcaatattttctgaaccaaaaatcagaacacatggtttgtgtcaaagggtttttctgtgctacgtctgggagtgctgacctaagtgacatttttttttaatgccaaatacagtaatctccaagcttttaatggcttatgccaagatgacagaatatgtgaaatctgattgtcccagagttacactctgcactccaaagctacaacagtgccacagctgagaggtttccctatacttcctactactgtgacaatttagcaatccttcaaatggaaaattcctaattacacgagacaatggtcctacagtaggcccgtgcggaataagttccctcgttggaaaaatgctagcatgaatagtttgataaatgcaatccatcagcaaaggagagcaagcaggcagagactgtgccaagcagaaactcattcgcatcaagttttccaataagtttccttcccccagtcccttttcttcaatcctgcttttaagccaggccccagggtaagtctggtagaacactgagcaggaaagcttggaagggttctacaccacttcaaaaatacctttgcttaaaaacacttatatagccagtgattagcaattaaaatgtgaaaataatcaactactcagtagttaaattctgctaattatcaaaagtcatagtctactgggatcagcagcattacaaaaggaagtcatatcgcatttcttaagctttttctgaatggtttaacaggtctctttcagtgttaattgcacttaaaacatctgctttttttcatttaatctctgaaatctgttcattttttccctccatttataaaaaggggtcaatttatcatttgctctatagctatttgaattcgaaaaagattccacaaaatttgagttgcacacaggcgctttctgaagcagattaaacttgtccttgtgacacttcagagcttggactgcagtgacttcaggtgcttgtaagattcgtggacctctgctttgttcagtggggagttcttagcccactcaaacaagttttcatacacattcccatcatagcggccaagcacagagccaagtgtcacatcctgaaaatcaaatgcatcaaccaaagcaacagcatctgagcgaatcagagtgagtaactcctttacacgctggtttacttgtgtaatctgaggctctgtcatgatgctcccctgaaggaaatcccccgcgttctgactgattccatacagagaatacagcagacataaactccttaagacagcttgaatggctttatcttgaattttgaggagtttttctgaaaagagcttaactaccacatagtggcaatgtgcctcacttgctcgaacaaggtcaacagaagttaggttccaagctacctccttgctttttctgtgaatcacttctttttgaaggttttttgcagcaatttctactaatctggctgcacggagtttatatgcttcggttaggctttcggggctgttgatatccaccatggttggccagactgctacctgctgtggctggatgcgctgactgggcaggtcgttcaaataggacaccatgccacacaccaactttcctgagtgcacctgatcataacttttcatcaggaacctagccgtctggagcatcatgacagtgttttctccctcaaaggtacagcttggggtgaaattgacataaatatttggaagaccactgcaatgagaatagccatgcccaccacaagccatccgacatgcttcaatgccagtgtttgcagtccaggaggtgaaagccttcagtccagcggtgagggcatgaagctcaggcagttcactcaggtccccttgaccaatgccttcgttaatccggtgataggtctccttcatgtatgcgcccacaaactggaaggcataggcagtggccaggagtggaaagagtttatactgctgggtttgaaaatccaaaatctgtggttctggttcacctggcttcatttcagactggtgcctcacagcgctgtatcggatggcaatggtgcacgccttagacagagcccgagcagcttctcccacaaggaaggacctgacaaacaccatggtcccgtaagtcagcttgttactcagcggtttcacgtatgtgccatcaggcttcacctgggcatacttcatcagcatgttttctctgggaatacgatggttgtccattttgaggtagccattgtctatctcatcataaccaaatttggggccgatgtcaccaacggtaattcctggcaaaggcttatgggtcccgatttcacgaataggtacgataaaggcatgtaatccatagcatttccccttagtgatgagctgggcaagaactattgcatgatttgaagtctttccaagcccaccaggccaccatttaatggaggtcacagtaggactgttgagaatgaactcctgggtttcagggtcatacgtggctgtggtttccaagcctcgaaggtgagttccatgacccatctctgtctgggcataagtgccaatgatctccaagttccaggcgggcatgaagaagcgctcctgctgctccgcagttgcctggtgaagcaaggtgggcaggaacatgcccaagtgaagatccagaggctcaggccgccctcggtgcacaaaatttttaaaccacataatttcatcagggtcagcgatgccaaactccctcatcttcttcaccatgatggcacttttcctgacagccacctcataacgctggctgcgagtgaggaagttcaagtcctcatgctggaagtctgggtcgttcaggatcatgttctcgatctctcggcggcgccgggttttctcggggctgccgtccaggatgtgtgtaagcagctccgggttgaagctggcggaatcccgctccctgcgcaggtccgggttcatggcgacgaccagctggcagcgaagtaagcaccgaccgaggtggcagtgacaatctaaatccgcagctccagcgccggccggaccctaggaggcagcctcaggacggcgcaagtccccgcctccgctcgcccggcccgccccggcccgccccttctttctccgtggccctttggcgcgtgagtgacagcggcccagacagagggggcgatgtccgcgtcgtggctggggccggtcgcggggcagactaatcccctgctcctggccaggggaggctcccgagcggatcctcgggaaaggggctccgaaggtcaagaaactgccctgctgggcgtccggggagtgggaaaataaagcactttttgtatcccgcccctcccccgtcacgtgaccacgcgaggcggaaagaagaaatccgaggaccggcgacgcctagaacaggagcccatgatgctgcccaaacctgggacctattacctcccctgggaggttagtgcaggccaagttcctgatgggagcacgctgagaacatttggcaggttgtgcctctatgacatgattcagtccagagtaacactgatggctcagcacggatccgatcagcaccaggttcttgtctgtaccaagttggtggagcccttccacgcccaggtgggctccctgtacatcgtcctcggggagctccagcatcagcaggacagaggctccgtggtgaaggcgcgcgtgctgacctgtgtggaggggatgaacctgcccttgttggaacaagccatccgggagcagagactgtacaagcaggagcggggcggcagccagtaggaaacagcagcctagcaacaccctcacctgcttcagagcccgaaccctctggagctgcaggagcccgggagagcacagacgcctccccagcgacggccttgtctggagctcgaaagccgaggggcgggtgatgaatccagccccttcccctactttgggattggctcagcaatgagaacccagaaagcatgccataaatccgacagccccaccccaggagactgcaggtggccgagcttgggcgccggggccgtgcttggtgtggggccatggagggttccagaaggtcctggtgaataaaggcccagggggcgtgctcttgaa

SEQ ID NO: 287294 - DNA, 5904 bp, Homo sapiens
aagaaaaaattaattaagatgtatttaacctttaagtatagaatgattgtataaattagatttcaactgaaaggacaattagcgattcagagaaagctcctagaaatagactgaaaacaaagccatacatagagtaagaaatagaacctatggaacttccatttttctaactatagttttttgtttttgttttttcccagttgttaaaaaaaaaacaactcacagtttcaatattttctgaaccaaaaatcagaacacatggtttgtgtcaaagggtttttctgtgctacgtctgggagtgctgacctaagtgacatttttttttaatgccaaatacagtaatctccaagcttttaatggcttatgccaagatgacagaatatgtgaaatctgattgtcccagagttacactctgcactccaaagctacaacagtgccacagctgagaggtttccctatacttcctactactgtgacaatttagcaatccttcaaatggaaaattcctaattacacgagacaatggtcctacagtaggcccgtgcggaataagttccctcgttggaaaaatgctagcatgaatagtttgataaatgcaatccatcagcaaaggagagcaagcaggcagagactgtgccaagcagaaactcattcgcatcaagttttccaataagtttccttcccccagtcccttttcttcaatcctgcttttaagccaggccccagggtaagtctggtagaacactgagcaggaaagcttggaagggttctacaccacttcaaaaatacctttgcttaaaaacacttatatagccagtgattagcaattaaaatgtgaaaataatcaactactcagtagttaaattctgctaattatcaaaagtcatagtctactgggatcagcagcattacaaaaggaagtcatatcgcatttcttaagctttttctgaatggtttaacaggtctctttcagtgttaattgcacttaaaacatctgctttttttcatttaatctctgaaatctgttcattttttccctccatttataaaaaggggtcaatttatcatttgctctatagctatttgaattcgaaaaagattccacaaaatttgagttgcacacaggcgctttctgaagcagattaaacttgtccttgtgacacttcagagcttggactgcagtgacttcaggtgcttgtaagattcgtggacctctgctttgttcagtggggagttcttagcccactcaaacaagttttcatacacattcccatcatagcggccaagcacagagccaagtgtcacatcctgaaaatcaaatgcatcaaccaaagcaacagcatctgagcgaatcagagtgagtaactcctttacacgctggtttacttgtgtaatctgaggctctgtcatgatgctcccctgaaggaaatcccccgcgttctgactgattccatacagagaatacagcagacataaactccttaagacagcttgaatggctttatcttgaattttgaggagtttttctgaaaagagcttaactaccacatagtggcaatgtgcctcacttgctcgaacaaggtcaacagaagttaggttccaagctacctccttgctttttctgtgaatcacttctttttgaaggttttttgcagcaatttctactaatctggctgcacggagtttatatgcttcggttaggctttcggggctgttgatatccaccatggttggccagactgctacctgctgtggctggatgcgctgactgggcaggtcgttcaaataggacaccatgccacacaccaactttcctgagtgcacctgatcataacttttcatcaggaacctagccgtctggagcatcatgacagtgttttctccctcaaaggtacagcttggggtgaaattgacataaatatttggaagaccactgcaatgagaatagccatgcccaccacaagccatccgacatgcttcaatgccagtgtttgcagtccaggaggtgaaagccttcagtccagcggtgagggcatgaagctcaggcagttcactcaggtccccttgaccaatgccttcgttaatccggtgataggtctccttcatgtatgcgcccacaaactggaaggcataggcagtggccaggagtggaaagagtttatactgctgggtttgaaaatccaaaatctgtggttctggttcacctggcttcatttcagactggtgcctcacagcgctgtatcggatggcaatggtgcacgccttagacagagcccgagcagcttctcccacaaggaaggacctgacaaacaccatggtcccgtaagtcagcttgttactcagcggtttcacgtatgtgccatcaggcttcacctgggcatacttcatcagcatgttttctctgggaatacgatggttgtccattttgaggtagccattgtctatctcatcataaccaaatttggggccgatgtcaccaacggtaattcctggcaaaggcttatgggtcccgatttcacgaataggtacgataaaggcatgtaatccatagcatttccccttagtgatgagctgggcaagaactattgcatgatttgaagtctttccaagcccaccaggccaccatttaatggaggtcacagtaggactgttgagaatgaactcctgggtttcagggtcatacgtggctgtggtttccaagcctcgaaggtgagttccatgacccatctctgtctgggcataagtgccaatgatctccaagttccaggcgggcatgaagaagcgctcctgctgctccgcagttgcctggtgaagcaaggtgggcaggaacatgcccaagtgaagatccagaggctcaggccgccctcggtgcacaaaatttttaaaccacataatttcatcagggtcagcgatgccaaactccctcatcttcttcaccatgatggcacttttcctgacagccacctcataacgctggctgcgagtgaggaagttcaagtcctcatgctggaagtctgggtcgttcaggatcatgttctcgatctctcggcggcgccgggttttctcggggctgccgtccaggatgtgtgtaagcagctccgggttgaagctggcggaatcccgctccctgcgcaggtccgggttcatggcgacgaccagctggcagcgaagtaagcaccgaccgaggtggcagtgacaatctaaatccgcagctccagcgccggccggaccctaggaggcagcctcaggacggcgcaagtccccgcctccgctcgcccggcccgccccggcccgccccttctttctccgtggccctttggcgcgtgagtgacagcggcccagacagagggggcgatgtccgcgtcgtggctggggccggtcgcggggcagactaatcccctgctcctggccaggggaggctcccgagcggatcctcgggaaaggggctccgaaggtcaagaaactgccctgctgggcgtccggggagtgggaaaataaagcactttttgtatcccgcccctcccccgtcacgtgaccacgcgaggcggaaagaagaaatccgaggaccggcgacgcctagaacaggagcccatgatgctgcccaaacctgggacctattacctcccctgggaggttagtgcaggccaagttcctgatgggagcacgctgagaacatttggcaggttgtgcctctatgacatgattcagtccagagtaacactgatggctcagcacggatccgatcagcaccaggttcttgtctgtaccaagttggtggagcccttccacgcccaggtgggctccctgtacatcgtcctcggggagctccagcatcagcaggacagaggctccgtggtgaaggcgcgcgtgctgacctgtgtggaggggatgaacctgcccttgttggaacaagccatccgggagcagagactgtacaagcaggagcggggcggcagccagtaggaaacagcagcctagcaacaccctcacctgcttcagagcccgaaccctctggagctgcaggagcccgggagagcacagacgcctccccagcgacggccttgtctggagctcgaaagccgaggggcgggtgatgaatccagccccttcccctactttgggattggctcagcaatgagaacccagaaagcatgccataaatccgacagccccaccccaggagactgcaggtggccgagcagctctgtggccatggatatgttccagaaggtagagaagatcggagagggcacctatggggtggtgtacaaggccaagaacagggagacagggcagctggtggccctgaagaagatcagactggatttggagatggagggggtcccaagcactgccatcagggagatctcgctgctcaaggaactgaagcaccccaacatcgtccgactgctggacgtggtgcacaacgagaggaagctctatctggtgtttgagttcctcagccaggacctgaagaagtacatggactccaccccaggctcagagctccccctgcacctcatcaagagctacctcttccagctgctgcagggggtgagtttctgccactcacatcgggtcatccaccgagacctgaagccccagaacctgctcatcaatgagttgggtgccatcaagctggctgacttcggcctggctcgcgccttcggggtgcccctgcgcacctacacccatgaggtggtgacactgtggtatcgcgcccccgagattctcttgggcagcaagttctataccacagctgtggatatctggagcattggttgcatctttgcagagatggtgactcgaaaagccctgtttcctggtgactctgagattgaccagctctttcgtatctttcgtatgctggggacacccagcgaagacacatggcccggggtcacccagctgcctgactataagggcagcttccctaagtggaccaggaagggactggaagagattgtgcccaatctggagccagagggcagggacctgctcatgcaactcctgcagtatgaccccagccagcggatcacagccaagactgccctggcccacccgtacttctcatcccctgagccctccccagctgcccgccagtatgtgctgcagcgattccgccattgagaatgtcaaggccacactcagatcctttctcgagcagctgctgccccagctgcctcctacccattgccaagagaggatgcatctggggagagcaaagcactaaggaattcagcatcagcctgcagagggctgagtctgggttagtcctgcccgcaggttagcgagatcctgtgttgttttttgggttggacggtgccgtttcaaaatagaggcacagatgctccatgcacgaggggtccccgggcactggaacaagtgccaagttgaaggcagggggcctgccagagctgggtgtgggtattcaggccctcacctgccctgcctgcagggccagaccctgaggaaagggcgccccctgctggtctttttggatttaaaatgtttgggggaagagttgagttccagttcagtcccaagttaaacaggagggagtgagggagaggagagagggcgttccccggatcccaggagagctgggctatgactgcaataaggagttgttccttcacctgagatgtgcttcttttggttcatttctggcttgacaacaagaaataaacgtggtatgttcctgaaaaaaaaaaaatggcctcttggcttaacggggaccttttggccgttccctttttgaggttaataatgaacccgccactgacccctggcctggccgtcggcgccgaagcgcatactcaccaaggcgggataccgtttcccaaactaggataccccagaaaacattggaccaaggcccaaagggcataccacaagcgccgg

SEQ ID NO: 287295 - DNA, 4335 bp, Homo sapiens
  misc_feature (4219)..(4219): n is a, c, g, or t
  misc_feature (4225)..(4225): n is a, c, g, or t
  misc_feature (4227)..(4227): n is a, c, g, or t
  misc_feature (4232)..(4232): n is a, c, g, or t
  misc_feature (4234)..(4234): n is a, c, g, or t
  misc_feature (4238)..(4238): n is a, c, g, or t
  misc_feature (4247)..(4248): n is a, c, g, or t
  misc_feature (4254)..(4254): n is a, c, g, or t
  misc_feature (4257)..(4258): n is a, c, g, or t
  misc_feature (4268)..(4268): n is a, c, g, or t
  misc_feature (4277)..(4277): n is a, c, g, or t
  misc_feature (4279)..(4279): n is a, c, g, or t
aagaaaaaattaattaagatgtatttaacctttaagtatagaatgattgtataaattagatttcaactgaaaggacaattagcgattcagagaaagctcctagaaatagactgaaaacaaagccatacatagagtaagaaatagaacctatggaacttccatttttctaactatagttttttgtttttgttttttcccagttgttaaaaaaaaaacaactcacagtttcaatattttctgaaccaaaaatcagaacacatggtttgtgtcaaagggtttttctgtgctacgtctgggagtgctgacctaagtgacatttttttttaatgccaaatacagtaatctccaagcttttaatggcttatgccaagatgacagaatatgtgaaatctgattgtcccagagttacactctgcactccaaagctacaacagtgccacagctgagaggtttccctatacttcctactactgtgacaatttagcaatccttcaaatggaaaattcctaattacacgagacaatggtcctacagtaggcccgtgcggaataagttccctcgttggaaaaatgctagcatgaatagtttgataaatgcaatccatcagcaaaggagagcaagcaggcagagactgtgccaagcagaaactcattcgcatcaagttttccaataagtttccttcccccagtcccttttcttcaatcctgcttttaagccaggccccagggtaagtctggtagaacactgagcaggaaagcttggaagggttctacaccacttcaaaaatacctttgcttaaaaacacttatatagccagtgattagcaattaaaatgtgaaaataatcaactactcagtagttaaattctgctaattatcaaaagtcatagtctactgggatcagcagcattacaaaaggaagtcatatcgcatttcttaagctttttctgaatggtttaacaggtctctttcagtgttaattgcacttaaaacatctgctttttttcatttaatctctgaaatctgttcattttttccctccatttataaaaaggggtcaatttatcatttgctctatagctatttgaattcgaaaaagattccacaaaatttgagttgcacacaggcgctttctgaagcagattaaacttgtccttgtgacacttcagagcttggactgcagtgacttcaggtgcttgtaagattcgtggacctctgctttgttcagtggggagttcttagcccactcaaacaagttttcatacacattcccatcatagcggccaagcacagagccaagtgtcacatcctgaaaatcaaatgcatcaaccaaagcaacagcatctgagcgaatcagagtgagtaactcctttacacgctggtttacttgtgtaatctgaggctctgtcatgatgctcccctgaaggaaatcccccgcgttctgactgattccatacagagaatacagcagacataaactccttaagacagcttgaatggctttatcttgaattttgaggagtttttctgaaaagagcttaactaccacatagtggcaatgtgcctcacttgctcgaacaaggtcaacagaagttaggttccaagctacctccttgctttttctgtgaatcacttctttttgaaggttttttgcagcaatttctactaatctggctgcacggagtttatatgcttcggttaggctttcggggctgttgatatccaccatggttggccagactgctacctgctgtggctggatgcgctgactgggcaggtcgttcaaataggacaccatgccacacaccaactttcctgagtgcacctgatcataacttttcatcaggaacctagccgtctggagcatcatgacagtgttttctccctcaaaggtacagcttggggtgaaattgacataaatatttggaagaccactgcaatgagaatagccatgcccaccacaagccatccgacatgcttcaatgccagtgtttgcagtccaggaggtgaaagccttcagtccagcggtgagggcatgaagctcaggcagttcactcaggtccccttgaccaatgccttcgttaatccggtgataggtctccttcatgtatgcgcccacaaactggaaggcataggcagtggccaggagtggaaagagtttatactgctgggtttgaaaatccaaaatctgtggttctggttcacctggcttcatttcagactggtgcctcacagcgctgtatcggatggcaatggtgcacgccttagacagagcccgagcagcttctcccacaaggaaggacctgacaaacaccatggtcccgtaagtcagcttgttactcagcggtttcacgtatgtgccatcaggcttcacctgggcatacttcatcagcatgttttctctgggaatacgatggttgtccattttgaggtagccattgtctatctcatcataaccaaatttggggccgatgtcaccaacggtaattcctggcaaaggcttatgggtcccgatttcacgaataggtacgataaaggcatgtaatccatagcatttccccttagtgatgagctgggcaagaactattgcatgatttgaagtctttccaagcccaccaggccaccatttaatggaggtcacagtaggactgttgagaatgaactcctgggtttcagggtcatacgtggctgtggtttccaagcctcgaaggtgagttccatgacccatctctgtctgggcataagtgccaatgatctccaagttccaggcgggcatgaagaagcgctcctgctgctccgcagttgcctggtgaagcaaggtgggcaggaacatgcccaagtgaagatccagaggctcaggccgccctcggtgcacaaaatttttaaaccacataatttcatcagggtcagcgatgccaaactccctcatcttcttcaccatgatggcacttttcctgacagccacctcataacgctggctgcgagtgaggaagttcaagtcctcatgctggaagtctgggtcgttcaggatcatgttctcgatctctcggcggcgccgggttttctcggggctgccgtccaggatgtgtgtaagcagctccgggttgaagctggcggaatcccgctccctgcgcaggtccgggttcatggcgacgaccagctggcagcgaagtaagcaccgaccgaggtggcagtgacaatctaaatccgcagctccagcgccggccggaccctaggaggcagcctcaggacggcgcaagtccccgcctccgctcgcccggcccgccccggcccgccccttctttctccgtggccctttggcgcgtgagtgacagcggcccagacagagggggcgatgtccgcgtcgtggctggggccggtcgcggggcagactaatcccctgctcctggccaggggaggctcccgagcggatcctcgggaaaggggctccgaaggtcaagaaactgccctgctgggcgtccggggagtgggaaaataaagcactttttgtatcccgcccctcccccgtcacgtgaccacgcgaggcggaaagaagaaatccgaggaccggcgacgcctagaacaggagcccatgatgctgcccaaacctgggacctattacctcccctgggaggttagtgcaggccaagttcctgatgggagcacgctgagaacatttggcaggttgtgcctctatgacatgattcagtccagagtaacactgatggctcagcacggatccgatcagcaccaggttcttgtctgtaccaagttggtggagcccttccacgcccaggtgggctccctgtacatcgtcctcggggagctccagcatcagcaggacagaggctccgtggtgaaggcgcgcgtgctgacctgtgtggaggggatgaacctgcccttgttggaacaagccatccgggagcagagactgtacaagcaggagcggggcggcagccagtaggaaacagcagcctagcaacaccctcacctgcttcagagcccgaaccctctggagctgcaggagcccgggagagcacagacgcctccccagcgacggccttgtctggagctcgaaagccgaggggcgggtgatgaatccagccccttcccctactttgggattggctcagcaatgagaacccagaaagcatgccataaatccgacagccccaccccaggagactgcaggtggccgaggcggctgggggggcaggggntccaangncgggnanaagncggggggcnngaaaanaannaacacaaacnaaaaaaaanancgggctcgggggaaaaagaagggtgccacgaaggaggccaggataagcgaacacac

SEQ ID NO: 287296 - DNA, 1780 bp, Homo sapiens
ccacatggaagctggaggagcaaccgggagcgctgggctggggtgcaaattgcccagtgccttctgtttcccaggcagctctgtggccatggatatgttccagaaggtagagaagatcggagagggcacctatggggtggtgtacaaggccaagaacagggagacagggcagctggtggccctgaagaagatcagactggatttggagatggagggggtcccaagcactgccatcagggagatctcgctgctcaaggaactgaagcaccccaacatcgtccgactgctggacgtggtgcacaacgagaggaagctctatctggtgtttgagttcctcagccaggacctgaagaagtacatggactccaccccaggctcagagctccccctgcacctcatcaagagctacctcttccagctgctgcagggggtgagtttctgccactcacatcgggtcatccaccgagacctgaagccccagaacctgctcatcaatgagttgggtgccatcaagctggctgacttcggcctggctcgcgccttcggggtgcccctgcgcacctacacccatgaggtggtgacactgtggtatcgcgcccccgagattctcttgggcagcaagttctataccacagctgtggatatctggagcattggttgcatctttgcagagatggtgactcgaaaagccctgtttcctggtgactctgagattgaccagctctttcgtatctttcgtatgctggggacacccagcgaagacacatggcccggggtcacccagctgcctgactataagggcagcttccctaagtggaccaggaagggactggaagagattgtgcccaatctggagccagagggcagggacctgctcatgcaactcctgcagtatgaccccagccagcggatcacagccaagactgccctggcccacccgtacttctcatcccctgagccctccccagctgcccgccagtatgtgctgcagcgattccgccattgagaatgtcaaggccacactcagatcctttctcgagcagctgctgccccagctgcctcctacccattgccaagagaggatgcatctggggagagcaaagcactaaggaattcagcatcagcctgcagagggctgagtctgggttagtcctgcccgcaggttagcgagatcctgtgttgttttttgggttggacggtgccgtttcaaaatagaggcacagatgctccatgcacgaggggtccccgggcactggaacaagtgccaagttgaaggcagggggcctgccagagctgggtgtgggtattcaggccctcacctgccctgcctgcagggccagaccctgaggaaagggcgccccctgctggtctttttggatttaaaatgtttgggggaagagttgagttccagttcagtcccaagttaaacaggagggagtgagggagaggagagagggcgttccccggatcccaggagagctgggctatgactgcaataaggagttgttccttcacctgagatgtgcttcttttggttcatttctggcttgacaacaagaaataaacgtggtatgttcctgaaaaaaaaaaaatggcctcttggcttaacggggaccttttggccgttccctttttgaggttaataatgaacccgccactgacccctggcctggccgtcggcgccgaagcgcatactcaccaaggcgggataccgtttcccaaactaggataccccagaaaacattggaccaaggcccaaagggcataccacaagcgccgg

SEQ ID NO: 287297 - DNA, 752 bp, Homo sapiens
atccggtttatcaggaatcttcaaaatccctctcaactatttggttacaggagcccatgatgctgcccaaacctgggacctattacctcccctgggaggttagtgcaggccaagttcctgatgggagcacgctgagaacatttggcaggttgtgcctctatgacatgattcagtccagagtaacactgatggctcagcacggatccgatcagcaccaggttcttgtctgtaccaagttggtggagcccttccacgcccaggtgggctccctgtacatcgtcctcggggagctccagcatcagcaggacagaggctccgtggtgaaggcgcgcgtgctgacctgtgtggaggggatgaacctgcccttgttggaacaagccatccgggagcagagactgtacaagcaggagcggggcggcagccagtaggaaacagcagcctagcaacaccctcacctgcttcagagcccgaaccctctggagctgcaggagcccgggagagcacagacgcctccccagcgacggccttgtctggagctcgaaagccgaggggcgggtgatgaatccagccccttcccctactttgggattggctcagcaatgagaacccagaaagcatgccataaatccgacagccccaccccaggagactgcaggtggccgagcttgggcgccggggccgtgcttggtgtggggccatggagggttccagaaggtcctggtgaataaaggcccagggggcgtgctcttgaa

SEQ ID NO: 287298 - DNA, 766 bp, Homo sapiens
gcgtgagccaccgcgcccggccacacatataactttataaagttgcatgaaaatatgccagtttgcatcttcaaacaccaagcacggtgatgaaaggccaccatagaccgcagctgtaaagtttaggcttaacaacacttgctctgttctaaggcatacctactttttaaaccacataatttcatcagggtcagcgatgccaaactccctcatcttcttcaccatgatggcacttttcctgacagccacctcataacgctggctgcgagtgaggaagttcaagtcctcatgctggaagtctgggtcgttcaggatcatgttctctgaaagggggttaaagggcattaaaaggcagacagacactcgggcctccgttccaccctccctgaatcacaataggcttcagagtcgcggacacacctggggaatggcgatatccccccaccagggacacaggctgttcctcgaagtgggggtcccggctcccctaacgctgggccagagggcctaggccccacagcgcccctgactccgcatcgagggagtctccagcttttctcgggaaaggagggaggtctcgcccgccgccctcaccgatctctcggcggcgccgggttttctcggggctgccgtccaggatgtgtgtaagcagctccgggttgaagctggcggaatcccgctccctgcgcaggtccgggttcatggcgacgaccagctggcagcgaagtaagcaccgaccgaggtggcagtgacaatctaaatccgc

SEQ ID NO: 287299 - DNA, 1002 bp, Homo sapiens
  misc_feature (886)..(886): n is a, c, g, or t
  misc_feature (892)..(892): n is a, c, g, or t
  misc_feature (894)..(894): n is a, c, g, or t
  misc_feature (899)..(899): n is a, c, g, or t
  misc_feature (901)..(901): n is a, c, g, or t
  misc_feature (905)..(905): n is a, c, g, or t
  misc_feature (914)..(915): n is a, c, g, or t
  misc_feature (921)..(921): n is a, c, g, or t
  misc_feature (924)..(925): n is a, c, g, or t
  misc_feature (935)..(935): n is a, c, g, or t
  misc_feature (944)..(944): n is a, c, g, or t
  misc_feature (946)..(946): n is a, c, g, or t
gctagtgaggctggttggaatcggacgaggtcgtggctggggccggtcgcggggcagactaatcccctgctcctggccaggggaggctcccgagcggatcctcgggaaaggggctccgaaggtcaagaaactgccctgctgggcgtccggggagtgggaaaataaagcactttttgtatcccgcccctcccccgtcacgtgaccacgcgaggcggaaagaagaaatccgaggaccggcgacgcctagaacaggagcccatgatgctgcccaaacctgggacctattacctcccctgggaggttagtgcaggccaagttcctgatgggagcacgctgagaacatttggcaggttgtgcctctatgacatgattcagtccagagtaacactgatggctcagcacggatccgatcagcaccaggttcttgtctgtaccaagttggtggagcccttccacgcccaggtgggctccctgtacatcgtcctcggggagctccagcatcagcaggacagaggctccgtggtgaaggcgcgcgtgctgacctgtgtggaggggatgaacctgcccttgttggaacaagccatccgggagcagagactgtacaagcaggagcggggcggcagccagtaggaaacagcagcctagcaacaccctcacctgcttcagagcccgaaccctctggagctgcaggagcccgggagagcacagacgcctccccagcgacggccttgtctggagctcgaaagccgaggggcgggtgatgaatccagccccttcccctactttgggattggctcagcaatgagaacccagaaagcatgccataaatccgacagccccaccccaggagactgcaggtggccgaggcggctgggggggcaggggntccaangncgggnanaagncggggggcnngaaaanaannaacacaaacnaaaaaaaanancgggctcgggggaaaaagaagggtgccacgaaggaggccaggataagcgaacacac

SEQ ID NO: 287300 - DNA, 5858 bp, Homo sapiens
aagaaaaaattaattaagatgtatttaacctttaagtatagaatgattgtataaattagatttcaactgaaaggacaattagcgattcagagaaagctcctagaaatagactgaaaacaaagccatacatagagtaagaaatagaacctatggaacttccatttttctaactatagttttttgtttttgttttttcccagttgttaaaaaaaaaacaactcacagtttcaatattttctgaaccaaaaatcagaacacatggtttgtgtcaaagggtttttctgtgctacgtctgggagtgctgacctaagtgacatttttttttaatgccaaatacagtaatctccaagcttttaatggcttatgccaagatgacagaatatgtgaaatctgattgtcccagagttacactctgcactccaaagctacaacagtgccacagctgagaggtttccctatacttcctactactgtgacaatttagcaatccttcaaatggaaaattcctaattacacgagacaatggtcctacagtaggcccgtgcggaataagttccctcgttggaaaaatgctagcatgaatagtttgataaatgcaatccatcagcaaaggagagcaagcaggcagagactgtgccaagcagaaactcattcgcatcaagttttccaataagtttccttcccccagtcccttttcttcaatcctgcttttaagccaggccccagggtaagtctggtagaacactgagcaggaaagcttggaagggttctacaccacttcaaaaatacctttgcttaaaaacacttatatagccagtgattagcaattaaaatgtgaaaataatcaactactcagtagttaaattctgctaattatcaaaagtcatagtctactgggatcagcagcattacaaaaggaagtcatatcgcatttcttaagctttttctgaatggtttaacaggtctctttcagtgttaattgcacttaaaacatctgctttttttcatttaatctctgaaatctgttcattttttccctccatttataaaaaggggtcaatttatcatttgctctatagctatttgaattcgaaaaagattccacaaaatttgagttgcacacaggcgctttctgaagcagattaaacttgtccttgtgacacttcagagcttggactgcagtgacttcaggtgcttgtaagattcgtggacctctgctttgttcagtggggagttcttagcccactcaaacaagttttcatacacattcccatcatagcggccaagcacagagccaagtgtcacatcctgaaaatcaaatgcatcaaccaaagcaacagcatctgagcgaatcagagtgagtaactcctttacacgctggtttacttgtgtaatctgaggctctgtcatgatgctcccctgaaggaaatcccccgcgttctgactgattccatacagagaatacagcagacataaactccttaagacagcttgaatggctttatcttgaattttgaggagtttttctgaaaagagcttaactaccacatagtggcaatgtgcctcacttgctcgaacaaggtcaacagaagttaggttccaagctacctccttgctttttctgtgaatcacttctttttgaaggttttttgcagcaatttctactaatctggctgcacggagtttatatgcttcggttaggctttcggggctgttgatatccaccatggttggccagactgctacctgctgtggctggatgcgctgactgggcaggtcgttcaaataggacaccatgccacacaccaactttcctgagtgcacctgatcataacttttcatcaggaacctagccgtctggagcatcatgacagtgttttctccctcaaaggtacagcttggggtgaaattgacataaatatttggaagaccactgcaatgagaatagccatgcccaccacaagccatccgacatgcttcaatgccagtgtttgcagtccaggaggtgaaagccttcagtccagcggtgagggcatgaagctcaggcagttcactcaggtccccttgaccaatgccttcgttaatccggtgataggtctccttcatgtatgcgcccacaaactggaaggcataggcagtggccaggagtggaaagagtttatactgctgggtttgaaaatccaaaatctgtggttctggttcacctggcttcatttcagactggtgcctcacagcgctgtatcggatggcaatggtgcacgccttagacagagcccgagcagcttctcccacaaggaaggacctgacaaacaccatggtcccgtaagtcagcttgttactcagcggtttcacgtatgtgccatcaggcttcacctgggcatacttcatcagcatgttttctctgggaatacgatggttgtccattttgaggtagccattgtctatctcatcataaccaaatttggggccgatgtcaccaacggtaattcctggcaaaggcttatgggtcccgatttcacgaataggtacgataaaggcatgtaatccatagcatttccccttagtgatgagctgggcaagaactattgcatgatttgaagtctttccaagcccaccaggccaccatttaatggaggtcacagtaggactgttgagaatgaactcctgggtttcagggtcatacgtggctgtggtttccaagcctcgaaggtgagttccatgacccatctctgtctgggcataagtgccaatgatctccaagttccaggcgggcatgaagaagcgctcctgctgctccgcagttgcctggtgaagcaaggtgggcaggaacatgcccaagtgaagatccagaggctcaggccgccctcggtgcacaaaatttttaaaccacataatttcatcagggtcagcgatgccaaactccctcatcttcttcaccatgatggcacttttcctgacagccacctcataacgctggctgcgagtgaggaagttcaagtcctcatgctggaagtctgggtcgttcaggatcatgttctcgatctctcggcggcgccgggttttctcggggctgccgtccaggatgtgtgtaagcagctccgggttgaagctggcggaatcccgctccctgcgcaggtccgggttcatggcgacgaccagctggcagcgaagtaagcaccgaccgaggtggcagtgacaatctaaatccgcagctccagcgccggccggaccctaggaggcagcctcaggacggcgcaagtccccgcctccgctcgcccggcccgccccggcccgccccttctttctccgtggccctttggcgcgtgagtgacagcggcccagacagagggggcgatgtccgcgtcgtggctggggccggtcgcggggcagactaatcccctgctcctggccaggggaggctcccgagcggatcctcgggaaaggggctccgaaggtcaagaaactgccctgctgggcgtccggggagtgggaaaataaagcactttttgtatcccgcccctcccccgtcacgtgaccacgcgaggcggaaagaagaaatccgaggaccggcgacgcctagaacaggagcccatgatgctgcccaaacctgggacctattacctcccctgggaggttagtgcaggccaagttcctgatgggagcacgctgagaacatttggcaggttgtgcctctatgacatgattcagtccagagtaacactgatggctcagcacggatccgatcagcaccaggttcttgtctgtaccaagttggtggagcccttccacgcccagacagaggctccgtggtgaaggcgcgcgtgctgacctgtgtggaggggatgaacctgcccttgttggaacaagccatccgggagcagagactgtacaagcaggagcggggcggcagccagtaggaaacagcagcctagcaacaccctcacctgcttcagagcccgaaccctctggagctgcaggagcccgggagagcacagacgcctccccagcgacggccttgtctggagctcgaaagccgaggggcgggtgatgaatccagccccttcccctactttgggattggctcagcaatgagaacccagaaagcatgccataaatccgacagccccaccccaggagactgcaggtggccgagcagctctgtggccatggatatgttccagaaggtagagaagatcggagagggcacctatggggtggtgtacaaggccaagaacagggagacagggcagctggtggccctgaagaagatcagactggatttggagatggagggggtcccaagcactgccatcagggagatctcgctgctcaaggaactgaagcaccccaacatcgtccgactgctggacgtggtgcacaacgagaggaagctctatctggtgtttgagttcctcagccaggacctgaagaagtacatggactccaccccaggctcagagctccccctgcacctcatcaagagctacctcttccagctgctgcagggggtgagtttctgccactcacatcgggtcatccaccgagacctgaagccccagaacctgctcatcaatgagttgggtgccatcaagctggctgacttcggcctggctcgcgccttcggggtgcccctgcgcacctacacccatgaggtggtgacactgtggtatcgcgcccccgagattctcttgggcagcaagttctataccacagctgtggatatctggagcattggttgcatctttgcagagatggtgactcgaaaagccctgtttcctggtgactctgagattgaccagctctttcgtatctttcgtatgctggggacacccagcgaagacacatggcccggggtcacccagctgcctgactataagggcagcttccctaagtggaccaggaagggactggaagagattgtgcccaatctggagccagagggcagggacctgctcatgcaactcctgcagtatgaccccagccagcggatcacagccaagactgccctggcccacccgtacttctcatcccctgagccctccccagctgcccgccagtatgtgctgcagcgattccgccattgagaatgtcaaggccacactcagatcctttctcgagcagctgctgccccagctgcctcctacccattgccaagagaggatgcatctggggagagcaaagcactaaggaattcagcatcagcctgcagagggctgagtctgggttagtcctgcccgcaggttagcgagatcctgtgttgttttttgggttggacggtgccgtttcaaaatagaggcacagatgctccatgcacgaggggtccccgggcactggaacaagtgccaagttgaaggcagggggcctgccagagctgggtgtgggtattcaggccctcacctgccctgcctgcagggccagaccctgaggaaagggcgccccctgctggtctttttggatttaaaatgtttgggggaagagttgagttccagttcagtcccaagttaaacaggagggagtgagggagaggagagagggcgttccccggatcccaggagagctgggctatgactgcaataaggagttgttccttcacctgagatgtgcttcttttggttcatttctggcttgacaacaagaaataaacgtggtatgttcctgaaaaaaaaaaaatggcctcttggcttaacggggaccttttggccgttccctttttgaggttaataatgaacccgccactgacccctggcctggccgtcggcgccgaagcgcatactcaccaaggcgggataccgtttcccaaactaggataccccagaaaacattggaccaaggcccaaagggcataccacaagcgccgg

SEQ ID NO: 287301 - DNA, 1869 bp, Homo sapiens
ctaaggctaggtaggaggcccggtgttactcggccgatccagacgccttggaggacttggaacacctgtaacaggacaaggagtcctgctccggcacgtggccacagaaaactacttaggaagcctgtggtgagaacaacaacagtgcctggagaatcccacggctctggggaagtgagccccgaggatgaggctgctcgcctggctgattttcctggctaactggggaggtgccagggctgaaccagggaagttctggcacatcgctgacctgcaccttgaccctgactacaaggtatccaaagaccccttccaggtgtgcccatcagctggatcccagccagtgcccgacgcaggcccctggggtgactacctctgtgattctccctgggccctcatcaactcctccatctatgccatgaaggagattgagccagagccagacttcattctctggactggtgatgacacgcctcatgtgcccgatgagaaactgggagaggcagctgtactggaaattgtggaacgcctgaccaagctcatcagagaggtctttccagatactaaagtctatgctgctttgggaaatcatgattttcaccccaaaaaccagttcccagctggaagtaacaacatctacaatcagatagcagaactatggaaaccctggcttagtaatgagtccatcgctctcttcaaaaaaggtgccttctactgtgagaagctgccgggtcccagcggggctgggcgaattgtggtcctcaacaccaatctgtactataccagcaatgcgctgacagcagacatggcggaccctggccagcagttccagtggctggaagatgtgctgaccgatgcatccaaagctggggacatggtgtacattgtcggccacgtgcccccggggttctttgagaagacgcaaaacaaggcatggttccgggagggcttcaatgaaaaatacctgaaggtggtccggaagcatcatcgcgtcatagcagggcagttcttcgggcaccaccacaccgacagctttcggatgctctatgatgatgcaggtgtccccataagcgccatgttcatcacacctggagtcaccccatggaaaaccacattacctggagtggtcaatggggccaacaatccagccatccgggtgttcgaatatgaccgagccacactgagcctgaaggacatggtgacctacttcatgaacctgagccaggcgaatgctcaggggacgccgcgctgggagctcgagtaccagctgaccgaggcctatggggtgccggacgccagcgcccactccatgcacacagtgctggaccgcatcgctggcgaccagagcacactgcagcgctactacgtctataactcagtcagctactctgctggggtctgcgacgaggcctgcagcatgcagcacgtgtgtgccatgcgccaggtggacattgacgcttacaccacctgtctgtatgcctctggcaccacgcccgtgccccagctcccgctgctgctgatggccctgctgggcctgtgcacgctcgtgctgtgacctgccaggctcaccttcttcctggtaacgggtaacgggggcagcgcccaggatcacccagagctgggccttccaccatttcctccgcgcctgaggagtgaactgaaataggacaaccgaatcaggaagcgaagccccaggagctgcagccatccgtgatcgcgccactgcactccagcctgggcgacaaagccagactctctccaaaaacaaaccagaaacagaaaagaaatgacgacccaagacccccctacaagcatacttcttttgcgtattatgttttactcacaaaacaaagctcatcatgcgtttga

SEQ ID NO: 287302 - DNA, 1870 bp, Homo sapiens
atcataccctgctgggcaaaggaggaagagccagaggatccagacgccttggaggacttggaacacctgtaacaggacaaggagtcctgctccggcacgtggccacagaaaactacttaggaagcctgtggtgagaacaacaacagtgcctggagaatcccacggctctggggaagtgagccccgaggatgaggctgctcgcctggctgattttcctggctaactggggaggtgccagggctgaaccagggaagttctggcacatcgctgacctgcaccttgaccctgactacaaggtatccaaagaccccttccaggtgtgcccatcagctggatcccagccagtgcccgacgcaggcccctggggtgactacctctgtgattctccctgggccctcatcaactcctccatctatgccatgaaggagattgagccagagccagacttcattctctggactggtgatgacacgcctcatgtgcccgatgagaaactgggagaggcagctgtactggaaattgtggaacgcctgaccaagctcatcagagaggtctttccagatactaaagtctatgctgctttgggaaatcatgattttcaccccaaaaaccagttcccagctggaagtaacaacatctacaatcagatagcagaactatggaaaccctggcttagtaatgagtccatcgctctcttcaaaaaaggtgccttctactgtgagaagctgccgggtcccagcggggctgggcgaattgtggtcctcaacaccaatctgtactataccagcaatgcgctgacagcagacatggcggaccctggccagcagttccagtggctggaagatgtgctgaccgatgcatccaaagctggggacatggtgtacattgtcggccacgtgcccccggggttctttgagaagacgcaaaacaaggcatggttccgggagggcttcaatgaaaaatacctgaaggtggtccggaagcatcatcgcgtcatagcagggcagttcttcgggcaccaccacaccgacagctttcggatgctctatgatgatgcaggtgtccccataagcgccatgttcatcacacctggagtcaccccatggaaaaccacattacctggagtggtcaatggggccaacaatccagccatccgggtgttcgaatatgaccgagccacactgagcctgaaggacatggtgacctacttcatgaacctgagccaggcgaatgctcaggggacgccgcgctgggagctcgagtaccagctgaccgaggcctatggggtgccggacgccagcgcccactccatgcacacagtgctggaccgcatcgctggcgaccagagcacactgcagcgctactacgtctataactcagtcagctactctgctggggtctgcgacgaggcctgcagcatgcagcacgtgtgtgccatgcgccaggtggacattgacgcttacaccacctgtctgtatgcctctggcaccacgcccgtgccccagctcccgctgctgctgatggccctgctgggcctgtgcacgctcgtgctgtgacctgccaggctcaccttcttcctggtaacgggtaacgggggcagcgcccaggatcacccagagctgggccttccaccatttcctccgcgcctgaggagtgaactgaaataggacaaccgaatcaggaagcgaagccccaggagctgcagccatccgtgatcgcgccactgcactccagcctgggcgacaaagccagactctctccaaaaacaaaccagaaacagaaaagaaatgacgacccaagacccccctacaagcatacttcttttgcgtattatgttttactcacaaaacaaagctcatcatgcgtttga

SEQ ID NO: 287303 - DNA, 1597 bp, Homo sapiens
ctaaggctaggtaggaggcccggtgttactcggccgatccagacgccttggaggacttggaacacctgtaacaggacaaggagtcctgctccggcacgtggccacagaaaactacttaggaagcctgtggtgagaacaacaacagtgcctggagaatcccacggctctggggaagtgagccccgaggatgaggctgctcgcctggctgattttcctggctaactggggaggtgccagggctgaaccagggaagttctggcacatcgctgacctgcaccttgaccctgactacaaggtatccaaagaccccttccaggtgtgcccatcagctggatcccagccagtgcccgacgcaggcccctggggtgactacctctgtgattctccctgggccctcatcaactcctccatctatgccatgaaggagattgagccagagccagacttcattctctggactggtgatgacacgcctcatgtgcccgatgagaaactgggagaggcagctgtactggaaattgtggaacgcctgaccaagctcatcagagaggtctttccagatactaaagtctatgctgctttgggaaatcatgattttcaccccaaaaaccagttcccagctggaagtaacaacatctacaatcagatagcagaactatggaaaccctggcttagtaatgagtccatcgctctcttcaaaaaaggtgccttctactgtgagaagctgccgggtcccagcggggctgggcgaattgtggtcctcaacaccaatctgtactataccagcaatgcgctgacagcagacatggcggaccctggccagcagttccagtggctggaagatgtgctgaccgatgcatccaaagctggggacatggtgtacattgtcggccacgtgcccccggggttctttgagaagacgcaaaacaaggcatggttccgggagggcttcaatgaaaaatacctgaaggtggtccggaagcatcatcgcgtcatagcagggcagttcttcgggcaccaccacaccgacagctttcggatgctctatgatgatgcaggtgtccccataagcgccatgttcatcacacctggagtcaccccatggaaaaccacattacctggagtggtcaatggggccaacaatccagccatccgggtgttcgaatatgaccgagccacactgagcctgaaggtcaggagtcctgcggaggccagaggaggagggtgggaggggcttaaatgcatcaccaccttccctcactctcagcttatccaccttcccctgaccactgagcctcaggaaggttgagctccttccacccttctccagctcaggatcagaaccctggaggcacctgccaccgagtcagggcagtgcctcaccaagtcaccttttcccctggatgactgtcacagcctcatacctggtctccctgcctctggccctgccctgctatggcccatccgctacacaagagagaagaaactaatctcctatagcaccactttcatcttgtctccgtcctgctcaaaaaccttcagtggctccccagtgccttcaagataaagttgtgtctccttgacctagtactcaagg

SEQ ID NO: 287304 - DNA, 1960 bp, Homo sapiens
atcataccctgctgggcaaaggaggaagagccagaggatccagacgccttggaggacttggaacacctgtaacaggacaaggagtcctgctccggcacgtggccacagaaaactacttaggaagcctgtggtgagaacaacaacagtgcctggagaatcccacggctctggggaagtgagccccgaggatgaggctgctcgcctggctgattttcctggctaactggggaggtgccagggctgaaccagaggaagcgcaaggaccatgtgcccaagagaaaggcaaagggcctcccccaacatccatcctggccagcctggctccgggcttggaagcagggaagttctggcacatcgctgacctgcaccttgaccctgactacaaggtatccaaagaccccttccaggtgtgcccatcagctggatcccagccagtgcccgacgcaggcccctggggtgactacctctgtgattctccctgggccctcatcaactcctccatctatgccatgaaggagattgagccagagccagacttcattctctggactggtgatgacacgcctcatgtgcccgatgagaaactgggagaggcagctgtactggaaattgtggaacgcctgaccaagctcatcagagaggtctttccagatactaaagtctatgctgctttgggaaatcatgattttcaccccaaaaaccagttcccagctggaagtaacaacatctacaatcagatagcagaactatggaaaccctggcttagtaatgagtccatcgctctcttcaaaaaaggtgccttctactgtgagaagctgccgggtcccagcggggctgggcgaattgtggtcctcaacaccaatctgtactataccagcaatgcgctgacagcagacatggcggaccctggccagcagttccagtggctggaagatgtgctgaccgatgcatccaaagctggggacatggtgtacattgtcggccacgtgcccccggggttctttgagaagacgcaaaacaaggcatggttccgggagggcttcaatgaaaaatacctgaaggtggtccggaagcatcatcgcgtcatagcagggcagttcttcgggcaccaccacaccgacagctttcggatgctctatgatgatgcaggtgtccccataagcgccatgttcatcacacctggagtcaccccatggaaaaccacattacctggagtggtcaatggggccaacaatccagccatccgggtgttcgaatatgaccgagccacactgagcctgaaggacatggtgacctacttcatgaacctgagccaggcgaatgctcaggggacgccgcgctgggagctcgagtaccagctgaccgaggcctatggggtgccggacgccagcgcccactccatgcacacagtgctggaccgcatcgctggcgaccagagcacactgcagcgctactacgtctataactcagtcagctactctgctggggtctgcgacgaggcctgcagcatgcagcacgtgtgtgccatgcgccaggtggacattgacgcttacaccacctgtctgtatgcctctggcaccacgcccgtgccccagctcccgctgctgctgatggccctgctgggcctgtgcacgctcgtgctgtgacctgccaggctcaccttcttcctggtaacgggtaacgggggcagcgcccaggatcacccagagctgggccttccaccatttcctccgcgcctgaggagtgaactgaaataggacaaccgaatcaggaagcgaagccccaggagctgcagccatccgtgatcgcgccactgcactccagcctgggcgacaaagccagactctctccaaaaacaaaccagaaacagaaaagaaatgacgacccaagacccccctacaagcatacttcttttgcgtattatgttttactcacaaaacaaagctcatcatgcgtttga

SEQ ID NO: 287305 - DNA, 2193 bp, Homo sapiens
atcataccctgctgggcaaaggaggaagagccagaggatccagacgccttggaggacttggaacacctgtaacaggacaaggagtcctgctccggcacgtggccacagaaaactacttaggaagcctgtggtgagaacaacaacagtgcctggagaatcccacggctctggggaagtgagccccgaggatgaggctgctcgcctggctgattttcctggctaactggggaggtgccagggctgaaccagatgaggcaaatgagtctcagaggggacattgcacttgctgaagatctcccagctgggaaatggcaggacaaagcctgtgcctggctgtactatgcttcatgtcctcttgggatggtggggtttagaggcacccttctaggcactgaggacatagaggtaaacaagacgggcttggtgctctcatggaactgacattgtaaacagggaagatggacaataagcaagccaacaagaggaagcgcaaggaccatgtgcccaagagaaaggcaaagggcctcccccaacatccatcctggccagcctggctccgggcttggaagcagggaagttctggcacatcgctgacctgcaccttgaccctgactacaaggtatccaaagaccccttccaggtgtgcccatcagctggatcccagccagtgcccgacgcaggcccctggggtgactacctctgtgattctccctgggccctcatcaactcctccatctatgccatgaaggagattgagccagagccagacttcattctctggactggtgatgacacgcctcatgtgcccgatgagaaactgggagaggcagctgtactggaaattgtggaacgcctgaccaagctcatcagagaggtctttccagatactaaagtctatgctgctttgggaaatcatgattttcaccccaaaaaccagttcccagctggaagtaacaacatctacaatcagatagcagaactatggaaaccctggcttagtaatgagtccatcgctctcttcaaaaaaggtgccttctactgtgagaagctgccgggtcccagcggggctgggcgaattgtggtcctcaacaccaatctgtactataccagcaatgcgctgacagcagacatggcggaccctggccagcagttccagtggctggaagatgtgctgaccgatgcatccaaagctggggacatggtgtacattgtcggccacgtgcccccggggttctttgagaagacgcaaaacaaggcatggttccgggagggcttcaatgaaaaatacctgaaggtggtccggaagcatcatcgcgtcatagcagggcagttcttcgggcaccaccacaccgacagctttcggatgctctatgatgatgcaggtgtccccataagcgccatgttcatcacacctggagtcaccccatggaaaaccacattacctggagtggtcaatggggccaacaatccagccatccgggtgttcgaatatgaccgagccacactgagcctgaaggacatggtgacctacttcatgaacctgagccaggcgaatgctcaggggacgccgcgctgggagctcgagtaccagctgaccgaggcctatggggtgccggacgccagcgcccactccatgcacacagtgctggaccgcatcgctggcgaccagagcacactgcagcgctactacgtctataactcagtcagctactctgctggggtctgcgacgaggcctgcagcatgcagcacgtgtgtgccatgcgccaggtggacattgacgcttacaccacctgtctgtatgcctctggcaccacgcccgtgccccagctcccgctgctgctgatggccctgctgggcctgtgcacgctcgtgctgtgacctgccaggctcaccttcttcctggtaacgggtaacgggggcagcgcccaggatcacccagagctgggccttccaccatttcctccgcgcctgaggagtgaactgaaataggacaaccgaatcaggaagcgaagccccaggagctgcagccatccgtgatcgcgccactgcactccagcctgggcgacaaagccagactctctccaaaaacaaaccagaaacagaaaagaaatgacgacccaagacccccctacaagcatacttcttttgcgtattatgttttactcacaaaacaaagctcatcatgcgtttga

SEQ ID NO: 287306 - DNA, 586 bp, Homo sapiens
ttgcctcaatcaccttggagcctttcggatgctctatgatgatgcaggtgtccccataagcgccatgttcatcacacctggagtcaccccatggaaaaccacattacctggagtggtcaatggggccaacaatccagccatccgggtgttcgaatatgaccgagccacactgagcctgaaggtcaggagtcctgcggaggccagaggaggagggtgggaggggcttaaatgcatcaccaccttccctcactctcagcttatccaccttcccctgaccactgagcctcaggaaggttgagctccttccacccttctccagctcaggatcagaaccctggaggcacctgccaccgagtcagggcagtgcctcaccaagtcaccttttcccctggatgactgtcacagcctcatacctggtctccctgcctctggccctgccctgctatggcccatccgctacacaagagagaagaaactaatctcctatagcaccactttcatcttgtctccgtcctgctcaaaaaccttcagtggctccccagtgccttcaagataaagttgtgtctccttgacctagtactcaagg

SEQ ID NO: 287307 - DNA, 444 bp, Homo sapiens
taaataatttgcaccctacaacccatgtgtgaatttaattctggaaaaccaatctgagacagggacatccatcaccatgtgaaaaagcctgggatagtctgctggaagaaaatgtaacttgcagagaatagaacagataaaccttgcagtgtacccagttggatttcagaacattgaagagcagcagcttttatgggaataagagtgtcccttacagatgagaatcatcacggagcagagatgaggctaaacagctgaggcttctctaaaaaacaaaacaaacaaacaaacaaacaaaagcagtgcactcctcaggtgattggcatcggatagcagaagcatcggtgagtcagctgaggtacatagaagaaatgcctacctgagccaacccaaattgccaacccacaaaaatctgaaaccaaataaattgtttaaaactaaaag

SEQ ID NO: 287308 - DNA, 397 bp, Homo sapiens
gtcatgacttctcctagtgactttaagattatcgatgtgatttgctttgcctatgaggcaataagcaaatgtgacacaagcagaggcttaaaaatgcgtatgctttaggagaggttagctgttgctcttgggaaacacagaaccatataaagctgctaaccttctggcagatgagaatcatcacggagcagagatgaggctaaacagctgaggcttctctaaaaaacaaaacaaacaaacaaacaaacaaaagcagtgcactcctcaggtgattggcatcggatagcagaagcatcggtgagtcagctgaggtacatagaagaaatgcctacctgagccaacccaaattgccaacccacaaaaatctgaaaccaaataaattgtttaaaactaaaag

SEQ ID NO: 287309 - DNA, 496 bp, Homo sapiens
tgtaggccatggctttgaatgtggcgtgtgggatctctggcgggtcatcgtcacagagctctgcaaagcaaaagaagcctattaggaactcaagaggccccaggagttctgtatgcagctgaagggtaacatcccttgggagcttttgccttgtctggctgacgccttggcaatcgcaagtgacagtgacggagagccacctcctctggaatgcatcatggaacaggtctgggagaacagagggtgcagaaagggaaaagccaggcatttgtagtcctcctgccacagatgaccagaatgacctcacccaggacaaacggcgacagatttaggaattcaagccagcttttctgactcccaggcacctgctctctcctttcgagtgttcgactccactctcagtcactcgtcactcttcccagaaggacaaatgtgcagcttctatgtcttggatttcaaataaaagacgaggaacttggtgaaatgaggtggtctt

SEQ ID NO: 287310 - DNA, 420 bp, Homo sapiens
aaacagtgataattctgaaactagctaggtttggtggcattcatactccagaatgagcaggtaggagtaggacttgttatctgtcaaattgagattgacatactgtgactgtgattcagtaaggaaaggagcaaaaggatatgaaaacaagaagattttttgcttttcgctcttaatagtattatctactagggttgctagtagacactgctctgtattttgttgaatatgctgaatgagcctttgacattgagaaggagcagaaagcacggttgatgctattttcttcacttcaaactggagaaaacttagttgtttggacttaaaattgtttgaatataaaatcttgaaagattcttgtttctttcaggagacaatatatttcatatagataaaatgttattaaagaatttaaagttt

SEQ ID NO: 287311 - DNA, 691 bp, Homo sapiens
tgtatatcccctaaactcctcacctatatcacaaaaacctgccaaggcagaatacattcccaagggaaaggagctttggccgcaagcaggcatcgggtcccatctgacaccagcgtgatcgccacaggagccatctaggaaaggggaatggaaactgagatgctggcactttggccctgccaatgagctaaagcagtgtataattaaggaattgcacaggcttccttccccaggacaaagcagcgcacagtcttcttggattactgtcctcttacagcaataattacctgtggataatagattatattattggaagggcacacacgcttgctgccagccacgttcttcttggtgggctgcccacttctgctgcagaactgatgagcatcatgccagcggagaagagcttgagcctaggaacacaatgatgggcctggtgtcatttggagagaatgcggggctcatctttaacagaactgggcctagtgtctggaacaactcacagaaaaatgccaatctctttacagctcacgtaatttaaatggttactgtttaaatttcaggacaagtaaactaactgaacatattcctctgagcatcagaaatctgaataaaagaaagcatatttttaaatgtattattatttaaaacatatgaagtatatgaggtaataaaatgaacacccatgtat

SEQ ID NO: 287312 - DNA, 6208 bp, Homo sapiens
  misc_feature (130)..(130): n is a, c, g, or t
  misc_feature (2470)..(2470): n is a, c, g, or t
  misc_feature (3054)..(3054): n is a, c, g, or t
  misc_feature (3070)..(3070): n is a, c, g, or t
  misc_feature (3455)..(3455): n is a, c, g, or t
  misc_feature (4143)..(4143): n is a, c, g, or t
  misc_feature (6127)..(6127): n is a, c, g, or t
ctaaggaagttgggctcggtcccagtgtcaagtgtccatattttctttattttcttttagaaactaaagggaagggaatgaaccatttcagagcatcaaccgaaacaagttaaaagaattgatctttgcntagaagaataactagttgtttcaagtctcatatgctacatactgtgtctttttgaataccaggttatacctcagctcattgcaagaattgatacgcccagacccttggtgggacgtctcattcaccagcttctcacagacattggtcggtaccacccccaggtatgtggagactctgggcagtttctcatctaaccactggtttggtggtcagcctttccaaaagctgccctggcgacacaagcgcaggaactgggagccatgtgttccatcctggcccaggagggtctgtccagccagccgtcccagagggcccgggagccttgctaaaaagaaagcgttccctcgaagactgagccccttcctggtagtctcaagcagatgttaatgtcacactcaccacttgttttgttattctccttaaaattcataccagctcttccccaacccacatttcctttatagatgtttcttctgtttttccctcaggccctcatctacccactgacagtggcttctaagtctaccacgacagcccggcacaatgcagccaacaagattctgaagaacatgtgtgagcacagcaacaccctggtccagcaggccatgatggtgggtcggagccactgtggggcttcatagaccctggtcccttagctggtgggcgcaagtgggattgtttttcttcctcgcattggtgctgtgcacttcctctgactgctggaaatagtacctcctgtgtctccaaaacagacctttctgaggttagctgattcttggtgcttctctccttcttctcttggcttcaggtgagcgaggagctgatccgagtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggtatggggtaaaaaacacgaaaggacataaccctgtagaaatattctgccactaaaaaaaaatgaaatgagaaaagtttttatagaatgaaaggacgtgacccaaggcctttgtcagatttcttttcctctggcctttccactgactttaataaaacgagctctgatggaggtcacagagcataaaacatcagaaattagttacagggacccttctgaattttaactggaaaagcccaagatttctcaagaggtcatctcgtctctcctctcacccttccttccctataagccatgctgctggtttggaagctccagggttggaggcctgcacctatgctcttgctttctccagccccctgccagtgttttcaggccacagcgggctcctgaggaatatctgcagtcagcctggggattttgcctcctgggttggttgagactttgataacttgaaaacgtgcctgctttctctctcaggcctatggtcgagatttaatggaggcccaagagtggtgcaggaagtacatgaaatcagggaatgtcaaggacctcacccaagcctgggacctctattatcatgtgttccgacgaatctcaaagcagctgcctcaggtaggatcttcaggctcctggcagggttaactgtcattatagtcctttctgttttactgtctatgaatgttctaacactcattccaaagcatctggttttacttctgctttgggacaagtaattgttattagcaatccactgaaaaatacttaaattgcgtttaaattcttccctggaggcagaacactaaatcctttggtaattatttacagctcacatccttagagctgcaatatgtttccccaaaacttctgatgtgccgggaccttgaattggctgtgccaggaacatatgaccccaaccagccaatcattcgcattcagtccatagcaccgtctttgcaagtcatcacatccaagcagaggccccggaaattgacacttatgggtaaggaccattgtgcacttctgtcacccacttctccctcctacactggctgagaccccttccctcttctgaaattactgcttgccattcccactactcacctatcatagctacatctctcccatgctcattgagaggaaaatagagggcaagcaaatttctcattatgtcctcaggacttagttcattcatgtagttgggcttatgtgaagcatgatcacacataaagggaatgacaaaggcatgcaaggcagagaagtaacagtggaaggcaggtgttggagactgatgaggccagggaggaggcagctgggtgcaagcagggaaggtgctagctcctctgaaangggggcttctggctcttgaaatttttttctttttttttttaccatcatagtctctgtggtaaatgattgtgtaaaatgaacaagtggattctcacagtgagatttgttaagcaagtgggctctggaatttcccttggggtagagtgttacttatgggggatgttttagtgaggcctgagtgctgtggtggcactttgaggcctctcgctttttttttttttttttgagccagagttttgctcttgttgcccaggctggagtataatggcgcaatcttggctcactgcaacctccacctcccaggttcaagcaattctcctgtctcagcctcccgcgtagctgggattacaggcacgcaccaccacacctagctaatttttgtatttttaatagagttggggtttcaccatgttggccaggctggtctcgaactctgacctcaagtgatcagcctgtctcagccttccaaagtgctgggattacaggtgtgaaccactgcgcccagccacctcttgctctttttttttttttttccccaagacagagtctcactctgttgcccaggctggagtgaggtggtgtgntctcggctcactgcanccccacctcctgagttcaagcgattctcgtgcctcagcctccctaatagctgagattacaggcgcatgccacacaatcagctaatttttatatttttagtagagatgggatttcaccacgttggccaggctggtctcaaactcccgacctgaggtgatccgcccagcttggcctcccacaatgttaggattacaggtgtgagccaccgcgcccagcctcacctctcgctcttaataatgctcaatgtttcttaaatgcagtgattattcaccaacaccaattaatcatggtccacaggtgattatctctgcatgagctgttgtcttctgatacaaaatgtgggtcaggctggttcttggggtgtttaattaaagagagtttaagnaaggaattgtttccagaggtgtaagcaaagctaagagaatcaacaaggagcgctcatgaacaagcacaagtgagaaattgttactcagccctcacccacccccacactccagaactgaaagagcaaggagcccagctagaaccgtcaccatgccagagaggccatctagcagagtctacagtccagagagagtggtagcttctagaactggggccaggctggtgatgggggacacataccctgacctctccctctacccatcctctgacctcctgccagtacccttccaccattggccacgcccaagtgggatcccaggtgatgcggcttgtaggagtcaggcttctcagaacagaggaggacagagtgggtcggaaaacaggaatgatcatttccatgcctaaccgttcctggtcctcaaaaacagattttgttttgttttaatttgaacaacactggtcattgagaaccataaaaggcaaagccactcttttcattaattctaaagattgttttttctttttgtgaggaacgtgtgattaggtaaggcatatgtagtctgtgggatctcttgaatgcagtggtgctctcagctgaagagctgaggacctctgatgtacactcaccgctcccactgttccttacaggcagcaacggacatgagtttgttttccttctaaaaggccangaagatctgcgccaggatgagcgtgtgatgcagctcttcggcctggttaacacccttctggccaatgacccaacatctcttcggaaaaacctcaggtattcagaaaccctgaaatggcaacaatttgagaagtcttctggttttttcctacatttgtctcgtgtagtcatgtattatatcttaacaaaaaactataaaattagggagccaggcatggtaactcatgcctgtagtcccagaaactccagaggttgaggcagggggatggcttgagcccaggagttcaaggctgcagtgagctgtgattgtgccactgccctccagcctgggtaatagagcaagactgtctctttagaagaaaaaggctgggcatggtggctcgcacctataatcctaatattttgtaatgccaaggtaggaggatcacttgagcccaggaattcaagaccagcctaaacaacatagagagaccccatcactatttatttaaaaaaattaaaaaggtgaccgggcacggtggcccatgcctataatcccagcactttgggaggcccaggcaggtggatcacttgaggtcaggagttcgagaccagcctggccaacatggtgaaaccctgtgtctactaaaaatacaaaaattagctgggcgtggtggcggccacctgtaatcccggctactcaggaggctgaggcacgagaattgcttgaacctgggaggcggaggttgcagtgagccaagattgcaccattgtactccaggctgggcaacaagagtgaaactccatctcaaaaataaataactaaagtaaggaaaaaaaaattaagtggccaggcatggtggctcacatgtaatcccgacactttggaaggctacagcaggaggattgcttgagaccaggagttcaagaccatcctggacaaaaaagtgagaccctgtctctacaaaaaataaaaaaatcagctgggcatggtggctcatgcctgttgtcccagctccttgggagatggaggcagaagaatcatcttagcccagttggttgaggctgcagtgagacaaggttgtgcctctacactctagcctgggcagcagagcaagaccctttctctcaaaaaataaagataggctgggcacagtgactcacgcctgtaatccctgtctctacaaaaaaaaaaaaaaaaaaagctgggcacagtgtagtcccagctactcagggggctgaggcaggagaatcacttgagcccaggaggtcgaggctacagtgagctgtgatggggcaactgtgctcgagcctaggtaacagcgagaccctatctcaaaaagtaaataatattttttaaatgttttaaaaatgaaaaattaagttataaaattttataatttataaccaagttcttccagagtttttagggtattttcattgggaaatgcctttaacaacctccaaagaatccagcagggagcaatttgtggcgggtagactggagagtctacagatgggatgggtctgaccccttgtgggatgaaagccaaacctttcccatcgtccgtattctggcactcctcttcctgttaaaaccatgagaattcacttgagaggtattttagtcacttgattgttcccccaaagccatgagtttcttgggcaggttgaggagacctgtgttgctttcactgcaccatcagtgcactgtctttctgtgatgccttattcttcacaaagcatccctcaacacacacttcacaccagcctgctgcggcgggggctcattaaaaatagtcagggccgccgggcgcggtggctcacgcctgtaatcccagcactttgggaggccaaggagggtggatcacgaggtcaggagttcgagaccagtctggccaacatagtgaaaccccgtctctactaaaaatacaaaaaattagccgggtgtggtgttgtgcatctgtaatcccagctactcgggaggctgacgcaggagaatcgcntgaacccaggaggcagaggttgcagtgaaccaaaatagtgacactgcattccagcctgggcaacagaacaagactccatct

SEQ ID NO: 287313 - DNA, 507 bp, Homo sapiens
atagttttccttaaagaggtagttttgaaattataactctctaagtgtcaagcactaatgagtatctaccattcatctccttccatatccccttacaaggtgctatggtctgaatgtctgtgttcccttaaattcatacactgacgcctaatgcccattgtgacagtattagaaagtagggcctttgggaggcaattgggaggacctcctttgggaggtcatgaaggccctaccctcataactggtattacgaagagacatctgaagagctagttagctccttccaccatgtaagaacacagcaagaaggcaccatgtatgaaccagagagcaaaagctctcaccacacaccgaaactgccggtgacttgatcgtgaacttcccagcctccagaactgtgagcaatacattcctgttgtttataagccacccactgtaaggtatttttgttacagcagcccaaacaaaccaagacactagataagacttctggcatacttttagccc

SEQ ID NO: 287314 - DNA, 797 bp, Homo sapiens
atagttttccttaaagaggtagttttgaaattataactctctaagtgtcaagcactaatgagtatctaccattcatctccttccatatccccttacaaggtgctatggtctgaatgtctgtgttcccttaaattcatacactgacgcctaatgcccattgtgacagtattagaaagtagggcctttgggaggcaattgggaggacctcctttgggaggtcatgaaggccctaccctcataactggtattacgaagagacatctgaagagctagttagctccttccaccatgtaagaacacagcaagaaggcaccatgtatgaaccagagagcaaaagctctcaccacacaccgaaactgccggtgacttgatcgtgaacttcccagcctccagaactctacagagcagcatctgaagagccacggggcccccaccttcatccctgagaattttaggagccagcctgcctttccaggtgacactggacactttcatctgagaaccctgtcacatgacagttgtttcctttcttcctcctctcctgggaatgctgctgcttcgatgacccaagagcctaagaagggtagctgtttctcaatacactgagagagagttctttctccgtcctgaccatcttgggacccgatggcaagactggaaggatttatatctccttttgtacagaaaactgcctccccatgttggtttgtgaagtgaaatgcatataaaacagaggattccagactctcagaagtcaatacataaataaataaaaataaaactgagaagatacctca

SEQ ID NO: 287315 - DNA, 878 bp, Homo sapiens
  misc_feature (1)..(1): n is a, c, g, or t
  misc_feature (3)..(3): n is a, c, g, or t
ngncagggacagacgtaggccaagagaggggaaccagagaggaaccagaggggagagacagagcagcaagcagtggattgctccttgacgacgccagcatgagctccttctccaccaccaccgtgagcttcctccttttactggcattccagctcctaggtcagaccagagctaatcccatgtacaatgccgtgtccaacgcagacctgatggatttcaagaatttgctggaccatttggaagaaaagatgcctttagaagatgaggtcgtgcccccacaagtgctcagtgagccgaatgaagaagcgggggctgctctcagccccctccctgaggtgcctccctggaccggggaagtcagcccagcccagagagatggaggtgccctcgggcggggcccctgggactcctctgatcgatctgccctcctaaaaagcaagctgagggcgctgctcactgcccctcggagcctgcggagatccagctgcttcgggggcaggatggacaggattggagcccagagcggactgggctgtaacagcttccggtactgaagataacagccagggaggacaagcagggctgggcctagggacagactgcaagaggctcctgtcccctggggtctctgctgcatttgtgtcatcttgttgccatggagttgtgatcatcccatctaagctgcagcttcctgtcaacacttctcacatcttatgctaactgtagataaagtggtttgatggtgacttcctcgcctctcccaccccatgcattaaattttaaggtagaacctcacctgttactgaaagtggtttgaaagtgaataaacttcagcaccatggacagaagacaaaaaaagcctgcgttggtgtgctttc

SEQ ID NO: 287316 - DNA, 906 bp, Homo sapiens
aggcagccctgtctgaggccagaggtctgcccacgtggcggatgaggcaggtgtgaggccagcttgagcatctggatccatttgtctcgggctgctggctgcctgccatttcctcctctccacccttatttggaggccctgacagctgagccacaaacaaaccaggggagctgggcaccagccaagcgtcaccctctgtttccccgcacgggtaccagcgtcgaggagaaagaatcctgaggcacggcgaatttgctggaccatttggaagaaaagatgcctttagaagatgaggtcgtgcccccacaagtgctcagtgagccgaatgaagaagcgggggctgctctcagccccctccctgaggtgcctccctggaccggggaagtcagcccagcccagagagatggaggtgccctcgggcggggcccctgggactcctctgatcgatctgccctcctaaaaagcaagctgagggcgctgctcactgcccctcggagcctgcggagatccagctgcttcgggggcaggatggacaggattggagcccagagcggactgggctgtaacagcttccggtactgaagataacagccagggaggacaagcagggctgggcctagggacagactgcaagaggctcctgtcccctggggtctctgctgcatttgtgtcatcttgttgccatggagttgtgatcatcccatctaagctgcagcttcctgtcaacacttctcacatcttatgctaactgtagataaagtggtttgatggtgacttcctcgcctctcccaccccatgcattaaattttaaggtagaacctcacctgttactgaaagtggtttgaaagtgaataaacttcagcaccatggacagaagacaaaaaaagcctgcgttggtgtgctttc

SEQ ID NO: 287317 - DNA, 325 bp, Homo sapiens
aagttatctttgcatggctgattagcagttcatattcctccccagaattgcaagatcctgaagggcttaagtgaaatttactctgatgagtaacttgcttatcaattcatgaagctcagagggtcatcaggctggggtgggggccggtgggaagcaggtggtcagtaatcaagttcagaggatgggcacactcatacatgaagctgacttttccaggacagccaggtcaccaagccagatatgtctgtgttctctttgcagtactgaagataacagccagggaggacaagcagggctgggcctagggacagactgcaagaggctc

SEQ ID NO: 287318 - DNA, 1376 bp, Homo sapiens
tgcttctgtctctgtgaattttgactattctaggcacttcacaaaactggactcatacgatatctgtagttttgcgtctggcttctctattgaattcttaaaggggggtgggaactaagcagatcacaagggagctgcccacagaggtaaagacaaggtcaggtaggctgagagacgcaggaaagcgggtcaaggcgtagggctggagggcaggggcgggccctgggcgtgggctgggggtcctgccccggggcgcaccccgggcgagggctgcccggaggagccgaggttggcggacagcttggccctgagcttgaggggaaggcagcgatgggacaaaggacggaggtctaggaagagggtctgcagagcagaaagcacgggtaggggcggcctgacgctcggaagacaacggatgggagccgtgtgcacgtcgggagctcggagtgagcgtgagttccgtgcccaggcccgcgactcggcccgacaggacagcgctccgggtcgacggggtcctggagccgcgctcggggagggcgcagcggagggcgagcggcggcgttaggacccggaggcgcgggcggactgggggcggcggggctaggacccagcggctccggcagagcggaagcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcagggggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccggcacaggatccagagcaagcaccggcccctggacgagcgggccctgcaggagaagctgactttcctgtgtgcgtgagcaccaagccggagcccgaggacgatgcagaagagggacttgggggtcttcccagcaacatcagctctgtcagctccttgctgctcttcaacaccaccgagaacctgtagaagaagtatgtcttcctgggaccccctggctggtgctgtaacaaagacccatgtgatgctggggggcagagacagaggagaagctggtttgatgcccccttgtccatcaggcagagagaggcgcctggaacagcaggtcccagagaactacttctatgttgccggacctgg

SEQ ID NO: 287319 - DNA, 1099 bp, Homo sapiens
accccacttagcctcctggtttcctgtggtggctctgctctcacaactcatgcttttcctcccattggagggcctattccttcacgttttcctgcagccaacaaatatttacccagcagtgctcgtgtgcaaggcagtgtgggaatctctatatatccagccacggataaggcaacatacctctccacctggagcgcacattctggcaggagagaaagacctaaataagcaatagatgattagttcttcaataacagttgtgacaaggtctattgataatattttgtaatcactaatattcatataaaccgtgcacaaccattgatttgagtgcattaactcacacttcatgagcaggcactgccgtcatctcattttatagatgaggaaactgaggcacagaagggctgagagacctggcctagtgacagagccaggattcaaagccatagatcatggccccgggttatgtaggttattactgcatctgttcaggggagatggggtactgtgaggctcgtcatgggaagcctggcttggtctcaggtcagggaaggcagacgtgaggaaatgacatttatggtaaagtctgagggttgagtgggtaggttgggaagaacattccagaaagaagcacatgaactacagcctggaggtggaggacctaaaaggaagccagcatggctggagcacggagtggccattgagggaggcgagctggagggctgcagcttcttgtattggcagtgctgacctcgcacagtccttgggctccagtgacttcactcagtgtttatctaacatgagtgagtgaatggtgtttgctctttttttggtaaaggtcccaggggttgtcgggtacacaggtcctgtctttggccataagcaaactgaaatgaggcttggtctccttcccaggatcccacaccatgcctcacatggtagaccccagtgggaagtatgtgactgcctgactcaggtgcctctcgtggtccaagccatccctgccctgtcccttccctggttgtcgccagacctggagcccctgctccttcactttgcagcctcctcttctgtcaccaactgggaacccacctct

SEQ ID NO: 287320 - DNA, 532 bp, Homo sapiens
cactcagcaggcatcagcagagtcccatctatgcgctcctggcctctcagcaaatgctctgtcccctactcccctatctgtgcaggctgaagctatgtgcatagttgggatgagggctgtgttgtctcaacaccacgctgccctgtggtgggggcgtgccggtggtcgtgggtggctctgacgctccggctccgacccacaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtgggtgctgccactcacccccacctgatgagagggccatccctgtcctgggcaatcccagcaacacaccctctgggagcagcccccttggggaatcccggtcctggggaacccatctggcttccctgtgtgggaggggctgaagtgagagcccaacttggaagcttttactcctg

SEQ ID NO: 287321 - DNA, 995 bp, Homo sapiens
tgcttctgtctctgtgaattttgactattctaggcacttcacaaaactggactcatacgatatctgtagttttgcgtctggcttctctattgaattcttaaaggggggtgggaactaagcagatcacaagggagctgcccacagaggtaaagacaaggtcaggtaggctgagagacgcaggaaagcgggtcaaggcgtagggctggagggcaggggcgggccctgggcgtgggctgggggtcctgccccggggcgcaccccgggcgagggctgcccggaggagccgaggttggcggacagcttggccctgagcttgaggggaaggcagcgatgggacaaaggacggaggtctaggaagagggtctgcagagcagaaagcacgggtaggggcggcctgacgctcggaagacaacggatgggagccgtgtgcacgtcgggagctcggagtgagcgtgagttccgtgcccaggcccgcgactcggcccgacaggacagcgctccgggtcgacggggtcctggagccgcgctcggggagggcgcagcggagggcgagcggcggcgttaggacccggaggcgcgggcggactgggggcggcggggctaggacccagcggctccggcagagcggaagcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtgggtgctgccactcacccccacctgatgagagggccatccctgtcctgggcaatcccagcaacacaccctctgggagcagcccccttggggaatcccggtcctggggaacccatctggcttccctgtgtgggaggggctgaagtgagagcccaacttggaagcttttactcctg

SEQ ID NO: 287322 - DNA, 1821 bp, Homo sapiens
tgcttctgtctctgtgaattttgactattctaggcacttcacaaaactggactcatacgatatctgtagttttgcgtctggcttctctattgaattcttaaaggggggtgggaactaagcagatcacaagggagctgcccacagaggtaaagacaaggtcaggtaggctgagagacgcaggaaagcgggtcaaggcgtagggctggagggcaggggcgggccctgggcgtgggctgggggtcctgccccggggcgcaccccgggcgagggctgcccggaggagccgaggttggcggacagcttggccctgagcttgaggggaaggcagcgatgggacaaaggacggaggtctaggaagagggtctgcagagcagaaagcacgggtaggggcggcctgacgctcggaagacaacggatgggagccgtgtgcacgtcgggagctcggagtgagcgtgagttccgtgcccaggcccgcgactcggcccgacaggacagcgctccgggtcgacggggtcctggagccgcgctcggggagggcgcagcggagggcgagcggcggcgttaggacccggaggcgcgggcggactgggggcggcggggctaggacccagcggctccggcagagcggaagcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcagccaacaaatatttacccagcagtgctcgtgtgcaaggcagtgtgggaatctctatatatccagccacggataaggcaacatacctctccacctggagcgcacattctggcaggagagaaagacctaaataagcaatagatgattagttcttcaataacagttgtgacaaggtctattgataatattttgtaatcactaatattcatataaaccgtgcacaaccattgatttgagtgcattaactcacacttcatgagcaggcactgccgtcatctcattttatagatgaggaaactgaggcacagaagggctgagagacctggcctagtgacagagccaggattcaaagccatagatcatggccccgggttatgtaggttattactgcatctgttcaggggagatggggtactgtgaggctcgtcatgggaagcctggcttggtctcaggtcagggaaggcagacgtgaggaaatgacatttatggtaaagtctgagggttgagtgggtaggttgggaagaacattccagaaagaagcacatgaactacagcctggaggtggaggacctaaaaggaagccagcatggctggagcacggagtggccattgagggaggcgagctggagggctgcagcttcttgtattggcagtgctgacctcgcacagtccttgggctccagtgacttcactcagtgtttatctaacatgagtgagtgaatggtgtttgctctttttttggtaaaggtcccaggggttgtcgggtacacaggtcctgtctttggccataagcaaactgaaatgaggcttggtctccttcccaggatcccacaccatgcctcacatggtagaccccagtgggaagtatgtgactgcctgactcaggtgcctctcgtggtccaagccatccctgccctgtcccttccctggttgtcgccagacctggagcccctgctccttcactttgcagcctcctcttctgtcaccaactgggaacccacctct

SEQ ID NO: 287323 - DNA, 1382 bp, Homo sapiens
tgcttctgtctctgtgaattttgactattctaggcacttcacaaaactggactcatacgatatctgtagttttgcgtctggcttctctattgaattcttaaaggggggtgggaactaagcagatcacaagggagctgcccacagaggtaaagacaaggtcaggtaggctgagagacgcaggaaagcgggtcaaggcgtagggctggagggcaggggcgggccctgggcgtgggctgggggtcctgccccggggcgcaccccgggcgagggctgcccggaggagccgaggttggcggacagcttggccctgagcttgaggggaaggcagcgatgggacaaaggacggaggtctaggaagagggtctgcagagcagaaagcacgggtaggggcggcctgacgctcggaagacaacggatgggagccgtgtgcacgtcgggagctcggagtgagcgtgagttccgtgcccaggcccgcgactcggcccgacaggacagcgctccgggtcgacggggtcctggagccgcgctcggggagggcgcagcggagggcgagcggcggcgttaggacccggaggcgcgggcggactgggggcggcggggctaggacccagcggctccggcagagcggaagcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggagccctgagtccctttgaatgtggatgtgtgtcgtctgattcgtctttgactcccacggccccagcatgtgctctacaaatgggatgcactctggttattgaacagtgaggggtggaggggggagaaggaaagcaagggatgcttggagatggtcctctccggggcagatagaggaagatggacccttagtgagaccacgcgcagaacaggctgggtgagccacttccgtccctgatgtccacagaggcagcttcctctctagtgctgggtgagcgtgccatagggtatggcttcagcactgagcttgtaaactgacctaccttgaagtaggccaccaagccaagggcgtctggaccaggaatgacaaacaaatggcaccattcccccaccctcagggtgggacattgttcatcaacggcctggccccagtgaggcctaagggccttcccgacacagcttccagaccatcctgctagtccatggagatacaggatagctgaagtttctgatcctgagtctgacttttcttcggacatagctgtacgtaaaaataatgtccgg

SEQ ID NO: 287324 - DNA, 289 bp, Homo sapiens
aagggaggcatgagggatgtcaaggcccaagccactgaagcctggtgggtgctggccagacattctcagtgccattcaagtcccttcacgtggtaactttcccacagctgagggtcaaccatgagtggccagcgctcacagttgatgagaatggtggcattctccacggacatgcggtcggctgggaggccctcgttctgccaggcagccacgtcagcatcatccatcagcatcctcaggggatccagggctggggtgactggaatgggagtctggtgaagaagaaaca

SEQ ID NO: 287325 - DNA, 561 bp, Homo sapiens
gtgtgttgctgcagggaaggcttcccagtggaggtggctcctgagctctaggaaaagggaagtgagtgtccttccaggcagagggaacagcaggtgcaaaggcctgggggctcgtctataaggcccgctggagtcacaagccccatcccagactctccaacgctggacctgcagcgcccagccctgccctggtgctaccacctgccagctctgtgcctgcccctccactagatcatgacttcggctccagctccctcactctccatgcctctcacttgcgggttgtgccctgctcagctggccagactttggccccctccctacctggatttgtgaagccccaaatttcatctcccccaccacacttattcacagcctccgcctgctgacatacccaggcaagactcccttcccctccaggcagccaaacttcagttcgaatcttctggctcttaccagacccctgatgaatcccaggatcttcgcaggtggtcccagggcctctttgaaccacagttttacttatctgaaaaataaaaaggcatgatttagatgacttct

SEQ ID NO: 287326 - DNA, 488 bp, Homo sapiens
tcgaaggtaccccccgtaggatccggtggacaggactcaaacagatcctgtgaagcgaagacaatgaaccccggggagctctgcccaagtaccagatccggaagcaacccgaagcggcggcgcagcttgccgacgtctgcacgccgcacgctgtcgtgacatcagcgcgtcttggcgccgggtagtggagtggtcactttgggaaagtcaggcaggaatgacttgtttctgtgatgtctgtggcctcaactgggatgactcgaccagctggggacttgaaaatcgggcatctctttctctctcatcttgtagtcacagtctctccatgtggtctccccatacagcctcttcagcatcacaatctcaggatgtcaaacttggcacaatttgactctgatttttaccaatctaattttactattgataaccaggagcagagtggtaatgactctaatgcctatggaaatctttatggatctagaaagtaa

SEQ ID NO: 287327 - DNA, 504 bp, Homo sapiens
tatcatagacacagaagttacatatgcttttattaagagttaatgatttaaaaaataacctaatgatatgagtgctaaatttgtaaataattgaaatgagtcactttcttctggtaacaccttcctggggtttttagcttcaagagccaccatgctgacaagtaagcactttcattaccaatacttctttcaggctattccattccaagatgaccaaataggaacagctctggtctggagctcccagcgtgcccgacacagaagacgggtgatttctgcattttcacagagttattcctttgtagttgtgatccagcatggatgtggtgtggttgtatcagtgactgcaggtagtctgtggagcattacacagttctttacggaaatagcagctgcaagtgaccaggaccactgacagcagaaggcacctcacttaccatggtaaaaagcagtttagaaaaatctcaaaaacaaaataaatgtttattggagactcaaaatcat

SEQ ID NO: 287328 - DNA, 440 bp, Homo sapiens
tatcatagacacagaagttacatatgcttttattaagagttaatgatttaaaaaataacctaatgatatgagtgctaaatttgtaaataattgaaatgagtcactttcttctggtaacaccttcctggggctattccattccaagatgaccaaataggaacagctctggtctggagctcccagcgtgcccgacacagaagacgggtgatttctgcattttcacagagttattcctttgtagttgtgatccagcatggatgtggtgtggttgtatcagtgactgcaggtagtctgtggagcattacacagttctttacggaaatagcagctgcaagtgaccaggaccactgacagcagaaggcacctcacttaccatggtaaaaagcagtttagaaaaatctcaaaaacaaaataaatgtttattggagactcaaaatcat

SEQ ID NO: 287329 - DNA, 1406 bp, Homo sapiens
tatcatagacacagaagttacatatgcttttattaagagttaatgatttaaaaaataacctaatgatatgagtgctaaatttgtaaataattgaaatgagtcactttcttctggtaacaccttcctggggtatgttcttcactaaatgtttttgttatcttgcttaactttttctattcattcgttaaaatattatgtgaactatgaaaggtttttagcttcaagagccaccatgctgacaagtaagcactttcattaccaatacttctttcaggtgagcatctgcctgctgcaggtgtaccctcttggcactgagttctgagtttgcctttaattcaaaaaacaaagatacttgttcctcacaactgccaaaattttaaaaagcactgcctttatgaaagcatttctcactgcttctactcataataatgctccctatgaatgttcagtaatacaatctatttttctgaaaagcataactttctattctctaataaagtttatggagtacatttcctaactataataagcaagttgaatgtctcaatcctgcttcaggtatctttacaatttctgaggctttagcagaaccttgtatgtactaggtgcttgaaaaaaagtttgttaaactgagtcaagtgacagcatatttatctttctgggattgtgtggtaaagtggggaaaaagacatcaaacaatttcttaaaaacgaaatatagcagcaatccgcttttgtagatattaatcacacctgagcatatttagtctgtaaatacttattcatcttgcgtagatgatcatcttgaaaccgggtgaaaaaaaaatggcctggttttttaacgggataactttaacggggttttccgttttcataggccagtttatttttactttcagtgattttttccaccttctgttgggcaagctgataaggcaaacaaaggcatcagaacctctaggcatagaaaggaataaccattttcatttttaaacaagtatttacatccttaccatttctatcatcataagatcaagattcctatttatttgctactgctgcttttagtcttttcctacatagttgatcacagggctaatatgcaacatgtacagagactgctaataaaagcatgaagctttaagagtaccagagtttgttggttttgtatattaactttttttgttatgtcagttattcctttgtagttgtgatccagcatggatgtggtgtggttgtatcagtgactgcaggtagtctgtggagcattacacagttctttacggaaatagcagctgcaagtgaccaggaccactgacagcagaaggcacctcacttaccatggtaaaaagcagtttagaaaaatctcaaaaacaaaataaatgtttattggagactcaaaatcat

SEQ ID NO: 287330 - DNA, 2575 bp, Homo sapiens
agcggacttccgcgtccgccccgcggcgtccggcggccgcgccgagggtctggcgggccgcagagggagaccaagacatcattgttttgaagtttctgaaagtgttgggaggcaaaaattcaggtgcctgggggagaaatggaaggccacaaggcagaagaagaggtgctagatgttctccgactgaacgtgggtggctgtatttacacagcccggcgggagtccttgtgccgcttcaaggactccatgttggcatctatgttcagtggtcgctttcctctaaaaacagatgagtcaggggcttgtgttattgaccgtgatggacgtctatttaaataccttttggattaccttcatggagaagttcagattcccacagatgagcaaacccgcatcgccctacaggaagaggctgattactttggcatcccttatccatacagcctgtctgaccatttggccaatgaaatggagacatattctttaaggtcaaatatagaacttaaaaaggctttaacagacttctgtgattcatatggcttagtctgcaataaaccaacagtttgggttctccactatcttaacacatctggtgcaagctgtgagagtagaattattggtgtatatgccacaaaaactgatggaacagacgctattgaaaagcagctgggaggaagaattcacagcaaaggcatttttaaaagagaggcgggaaataatgttcagtacatttggagctattattcagtagcagagttgaagaaaatgatggatgcctttgatgcttgggaaggaaaaggtgttagctactggcgggtgcctcatgagctgatagagtgttggactctagaagaacggcctttacttggaagcctgcgtcacatggctccaattcgaaagaggcgactgataacgttcaatgaagcggacgaaagtgtgaactataagactggtcctaagccagttagatttttgggcccttccacaagtacccaaattaaagtcaagaactcggcctcagtcacggtgtctccagccagtgccatccagacgtcggctggggcgacagcaaaccggtttcaaagtggtagccgcagaaaggcagctcagcgctctgcaccttccagagccacggccctggtgggcacgggggcacctgggcatcctcaggcttcccctggggctgcgagcgctgaaaatggaggcacgcacttacctccagctaaggtgctactctccgacaagaagcctacaccccagcgggtgataaagctgaagaggactccgctgtgcgccaccgcgccttgcctgccctcccccacggccacgaggcaggccaactccctcaagccgcttcccggcgaagctgcccgtgccttgggagtgcggactgagaacgggaagaacaagggaaattgatgaaagtggtggacttgaaatttcccgttcatctcccaaagctttcaacccattcgacgcaaagaagtgacactttcttaatgcagcagaggggaagcttaggtttatgttgaggattctgttcctggaattgtgtgagctaggaatggaggaggggagactttcaatggttaaggctccatttctcattttcccaacttttatatgattgtctatgggcagtttgaatttctggttttcaatttattttttaatgattaattcgtattaaggcaacaagacagtacaacaaataatctctagagaggtccactttgttgctgaagtaaacgttacttgttgcaacccgaggatgggcatgaggtttggccttaggtattcctgtctgggaaaatggagggggtgatattagtggttccctgtactatatcacagccaagagagattagagagagaaaatgtagatcaaggcgagctgcctacaaattactctgtctccaaaggcaacgtgaaaagaaatgatggggaggaaaaaaccccatagattgaattagcactttgactctcacttaattcaacgattttctttcctagattggcttttcttactcttttctgttagtagatttatttataaacaccacaagaagatctcttgggatcagaattatataatatctttgaagtaaattattaaaatatcctatttaatttgaatagtgaagttttgaaaatactttgaaaaagagaagtaaaagtttaactttttaactaaagttagtatttgtttttcagaaatgaccactgaagattcattctgattatacaatatgatttttatgcataaaatttccatgtaacttgaatttaatatttttaaacagaatattttgactaatcctctattttttcatgactattcagttgtgtgtgtttattcgtaaatgttatgttttgtaattggatcacatatttctactttcagtgagagtatgccttcactatgttaaaaaataagctcataaaacagggtactttttattcaaatgcttatcattgtactttcattgctttgaaagagtaaagtaagtatactcaaaacattacgttttacaaaatcaaataaaacttttccataaaaagtggtaaaaaaaaa

SEQ ID NO: 287331 - DNA, 2959 bp, Homo sapiens
agcggacttccgcgtccgccccgcggcgtccggcggccgcgccgagggtctggcgggccgcaggtcagtctgggaagctgccgacccgccccacccccccggtgcggaagagccgggcgcgggatgggccgcgggcccggaaggcggcggggcgccctgaggaagggcacgggccgcgctggtaacgcgcgcgccccgggctgcaggctcgggcttcgggccgatttggggtctccaggccgcggaagaccgtggcggggctttctggctccccagctcctcccggctcttcccgcttcggaagaggagtgtgagccccttgagcgatgtttttcaaagtggggttcgcgggcagatcccgacccctcctcagactttctgaggaactgtgtgctgtggccggagtgtcttcgttttcccaagcgtccctgatggttttggatgcagagggagaccaagacatcattgttttgaagtttctgaaagtgttgggaggcaaaaattcaggtgcctgggggagaaatggaaggccacaaggcagaagaagaggtgctagatgttctccgactgaacgtgggtggctgtatttacacagcccggcgggagtccttgtgccgcttcaaggactccatgttggcatctatgttcagtggtcgctttcctctaaaaacagatgagtcaggggcttgtgttattgaccgtgatggacgtctatttaaataccttttggattaccttcatggagaagttcagattcccacagatgagcaaacccgcatcgccctacaggaagaggctgattactttggcatcccttatccatacagcctgtctgaccatttggccaatgaaatggagacatattctttaaggtcaaatatagaacttaaaaaggctttaacagacttctgtgattcatatggcttagtctgcaataaaccaacagtttgggttctccactatcttaacacatctggtgcaagctgtgagagtagaattattggtgtatatgccacaaaaactgatggaacagacgctattgaaaagcagctgggaggaagaattcacagcaaaggcatttttaaaagagaggcgggaaataatgttcagtacatttggagctattattcagtagcagagttgaagaaaatgatggatgcctttgatgcttgggaaggaaaaggtgttagctactggcgggtgcctcatgagctgatagagtgttggactctagaagaacggcctttacttggaagcctgcgtcacatggctccaattcgaaagaggcgactgataacgttcaatgaagcggacgaaagtgtgaactataagactggtcctaagccagttagatttttgggcccttccacaagtacccaaattaaagtcaagaactcggcctcagtcacggtgtctccagccagtgccatccagacgtcggctggggcgacagcaaaccggtttcaaagtggtagccgcagaaaggcagctcagcgctctgcaccttccagagccacggccctggtgggcacgggggcacctgggcatcctcaggcttcccctggggctgcgagcgctgaaaatggaggcacgcacttacctccagctaaggtgctactctccgacaagaagcctacaccccagcgggtgataaagctgaagaggactccgctgtgcgccaccgcgccttgcctgccctcccccacggccacgaggcaggccaactccctcaagccgcttcccggcgaagctgcccgtgccttgggagtgcggactgagaacgggaagaacaagggaaattgatgaaagtggtggacttgaaatttcccgttcatctcccaaagctttcaacccattcgacgcaaagaagtgacactttcttaatgcagcagaggggaagcttaggtttatgttgaggattctgttcctggaattgtgtgagctaggaatggaggaggggagactttcaatggttaaggctccatttctcattttcccaacttttatatgattgtctatgggcagtttgaatttctggttttcaatttattttttaatgattaattcgtattaaggcaacaagacagtacaacaaataatctctagagaggtccactttgttgctgaagtaaacgttacttgttgcaacccgaggatgggcatgaggtttggccttaggtattcctgtctgggaaaatggagggggtgatattagtggttccctgtactatatcacagccaagagagattagagagagaaaatgtagatcaaggcgagctgcctacaaattactctgtctccaaaggcaacgtgaaaagaaatgatggggaggaaaaaaccccatagattgaattagcactttgactctcacttaattcaacgattttctttcctagattggcttttcttactcttttctgttagtagatttatttataaacaccacaagaagatctcttgggatcagaattatataatatctttgaagtaaattattaaaatatcctatttaatttgaatagtgaagttttgaaaatactttgaaaaagagaagtaaaagtttaactttttaactaaagttagtatttgtttttcagaaatgaccactgaagattcattctgattatacaatatgatttttatgcataaaatttccatgtaacttgaatttaatatttttaaacagaatattttgactaatcctctattttttcatgactattcagttgtgtgtgtttattcgtaaatgttatgttttgtaattggatcacatatttctactttcagtgagagtatgccttcactatgttaaaaaataagctcataaaacagggtactttttattcaaatgcttatcattgtactttcattgctttgaaagagtaaagtaagtatactcaaaacattacgttttacaaaatcaaataaaacttttccataaaaagtggtaaaaaaaaa

SEQ ID NO: 287332 - DNA, 2937 bp, Homo sapiens
agcggacttccgcgtccgccccgcggcgtccggcggccgcgccgagggtctggcgggccgcaggtcagtctgggaagctgccgacccgccccacccccccggtgcggaagagccgggcgcgggatgggccgcgggcccggaaggcggcggggcgccctgaggaagggcacgggccgcgctggtaacgcgcgcgccccgggctgcaggctcgggcttcgggccgatttggggtctccaggccgcggaagaccgtggcggggctttctggctccccagctcctcccggctcttcccgcttcggaagaggagtgtgagccccttgagcgatgtttttcaaagtggggttcgcgggcagatcccgacccctcctcagactttctgaggaactgtgtgctgtggccggagtgtcttcgttttcccaagcgtccctgatggttttggatgcagagggagaccaagacatcattgttttgaagtttctgaaagtgttgggaggcaaaaattcaggtgcctgggggagaaatggaaggccacaaggcagaagaagaggtgctagatgttctccgactgaacgtgggtggctgtatttacacagcccggcgggagtccttgtgccgcttcaaggactccatgttggcatctatgttcagtggtcgctttcctctaaaaacagatgagtcaggggcttgtgttattgaccgtgatggacgtctatttaaataccttttggattaccttcatggagaagttcagattcccacagatgagcaaacccgcatcgccctacaggaagaggctgattactttggcatcccttatccatacagcctgtctgaccatttggccaatgaaatggagacatattctttaaggctttaacagacttctgtgattcatatggcttagtctgcaataaaccaacagtttgggttctccactatcttaacacatctggtgcaagctgtgagagtagaattattggtgtatatgccacaaaaactgatggaacagacgctattgaaaagcagctgggaggaagaattcacagcaaaggcatttttaaaagagaggcgggaaataatgttcagtacatttggagctattattcagtagcagagttgaagaaaatgatggatgcctttgatgcttgggaaggaaaaggtgttagctactggcgggtgcctcatgagctgatagagtgttggactctagaagaacggcctttacttggaagcctgcgtcacatggctccaattcgaaagaggcgactgataacgttcaatgaagcggacgaaagtgtgaactataagactggtcctaagccagttagatttttgggcccttccacaagtacccaaattaaagtcaagaactcggcctcagtcacggtgtctccagccagtgccatccagacgtcggctggggcgacagcaaaccggtttcaaagtggtagccgcagaaaggcagctcagcgctctgcaccttccagagccacggccctggtgggcacgggggcacctgggcatcctcaggcttcccctggggctgcgagcgctgaaaatggaggcacgcacttacctccagctaaggtgctactctccgacaagaagcctacaccccagcgggtgataaagctgaagaggactccgctgtgcgccaccgcgccttgcctgccctcccccacggccacgaggcaggccaactccctcaagccgcttcccggcgaagctgcccgtgccttgggagtgcggactgagaacgggaagaacaagggaaattgatgaaagtggtggacttgaaatttcccgttcatctcccaaagctttcaacccattcgacgcaaagaagtgacactttcttaatgcagcagaggggaagcttaggtttatgttgaggattctgttcctggaattgtgtgagctaggaatggaggaggggagactttcaatggttaaggctccatttctcattttcccaacttttatatgattgtctatgggcagtttgaatttctggttttcaatttattttttaatgattaattcgtattaaggcaacaagacagtacaacaaataatctctagagaggtccactttgttgctgaagtaaacgttacttgttgcaacccgaggatgggcatgaggtttggccttaggtattcctgtctgggaaaatggagggggtgatattagtggttccctgtactatatcacagccaagagagattagagagagaaaatgtagatcaaggcgagctgcctacaaattactctgtctccaaaggcaacgtgaaaagaaatgatggggaggaaaaaaccccatagattgaattagcactttgactctcacttaattcaacgattttctttcctagattggcttttcttactcttttctgttagtagatttatttataaacaccacaagaagatctcttgggatcagaattatataatatctttgaagtaaattattaaaatatcctatttaatttgaatagtgaagttttgaaaatactttgaaaaagagaagtaaaagtttaactttttaactaaagttagtatttgtttttcagaaatgaccactgaagattcattctgattatacaatatgatttttatgcataaaatttccatgtaacttgaatttaatatttttaaacagaatattttgactaatcctctattttttcatgactattcagttgtgtgtgtttattcgtaaatgttatgttttgtaattggatcacatatttctactttcagtgagagtatgccttcactatgttaaaaaataagctcataaaacagggtactttttattcaaatgcttatcattgtactttcattgctttgaaagagtaaagtaagtatactcaaaacattacgttttacaaaatcaaataaaacttttccataaaaagtggtaaaaaaaaa

SEQ ID NO: 287333 - DNA, 2577 bp, Homo sapiens
cagtaatgtcctgggccttcacattcattcaccactcactcactgactcacccagagcaacttccagtcctccaagccccattcatgagggagaccaagacatcattgttttgaagtttctgaaagtgttgggaggcaaaaattcaggtgcctgggggagaaatggaaggccacaaggcagaagaagaggtgctagatgttctccgactgaacgtgggtggctgtatttacacagcccggcgggagtccttgtgccgcttcaaggactccatgttggcatctatgttcagtggtcgctttcctctaaaaacagatgagtcaggggcttgtgttattgaccgtgatggacgtctatttaaataccttttggattaccttcatggagaagttcagattcccacagatgagcaaacccgcatcgccctacaggaagaggctgattactttggcatcccttatccatacagcctgtctgaccatttggccaatgaaatggagacatattctttaaggctttaacagacttctgtgattcatatggcttagtctgcaataaaccaacagtttgggttctccactatcttaacacatctggtgcaagctgtgagagtagaattattggtgtatatgccacaaaaactgatggaacagacgctattgaaaagcagctgggaggaagaattcacagcaaaggcatttttaaaagagaggcgggaaataatgttcagtacatttggagctattattcagtagcagagttgaagaaaatgatggatgcctttgatgcttgggaaggaaaaggtgttagctactggcgggtgcctcatgagctgatagagtgttggactctagaagaacggcctttacttggaagcctgcgtcacatggctccaattcgaaagaggcgactgataacgttcaatgaagcggacgaaagtgtgaactataagactggtcctaagccagttagatttttgggcccttccacaagtacccaaattaaagtcaagaactcggcctcagtcacggtgtctccagccagtgccatccagacgtcggctggggcgacagcaaaccggtttcaaagtggtagccgcagaaaggcagctcagcgctctgcaccttccagagccacggccctggtgggcacgggggcacctgggcatcctcaggcttcccctggggctgcgagcgctgaaaatggaggcacgcacttacctccagctaaggtgctactctccgacaagaagcctacaccccagcgggtgataaagctgaagaggactccgctgtgcgccaccgcgccttgcctgccctcccccacggccacgaggcaggccaactccctcaagccgcttcccggcgaagctgcccgtgccttgggagtgcggactgagaacgggaagaacaagggaaattgatgaaagtggtggacttgaaatttcccgttcatctcccaaagctttcaacccattcgacgcaaagaagtgacactttcttaatgcagcagaggggaagcttaggtttatgttgaggattctgttcctggaattgtgtgagctaggaatggaggaggggagactttcaatggttaaggctccatttctcattttcccaacttttatatgattgtctatgggcagtttgaatttctggttttcaatttattttttaatgattaattcgtattaaggcaacaagacagtacaacaaataatctctagagaggtccactttgttgctgaagtaaacgttacttgttgcaacccgaggatgggcatgaggtttggccttaggtattcctgtctgggaaaatggagggggtgatattagtggttccctgtactatatcacagccaagagagattagagagagaaaatgtagatcaaggcgagctgcctacaaattactctgtctccaaaggcaacgtgaaaagaaatgatggggaggaaaaaaccccatagattgaattagcactttgactctcacttaattcaacgattttctttcctagattggcttttcttactcttttctgttagtagatttatttataaacaccacaagaagatctcttgggatcagaattatataatatctttgaagtaaattattaaaatatcctatttaatttgaatagtgaagttttgaaaatactttgaaaaagagaagtaaaagtttaactttttaactaaagttagtatttgtttttcagaaatgaccactgaagattcattctgattatacaatatgatttttatgcataaaatttccatgtaacttgaatttaatatttttaaacagaatattttgactaatcctctattttttcatgactattcagttgtgtgtgtttattcgtaaatgttatgttttgtaattggatcacatatttctactttcagtgagagtatgccttcactatgttaaaaaataagctcataaaacagggtactttttattcaaatgcttatcattgtactttcattgctttgaaagagtaaagtaagtatactcaaaacattacgttttacaaaatcaaataaaacttttccataaaaagtggtaaaaaaaaa

SEQ ID NO: 287334 - DNA, 967 bp, Homo sapiens
tttttttggcggtataaaagtgcttctttatttggtcatacagctttcaaatgttgcttaacgaacagatagcatttttataatcagaggaaagactcagtattaaagtgcgcgtcccatcattgcaaccgggccctcgggcagccagctctctcttgcttcgcgtccggctctcaggccctggagctcggcctccctaccttctccaggcgcgggtcctgctccttttccggccgccctcgctccgccccttgagaccaagagaagggggaaatggggctgggggccgtccccgggagacaggcggccttccgagagggactggagcaggccgtgcggtatgccaaagccctgggctgtcccaggatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgtgagtatcagcctcgaggagacacagtagagggcttgagttggctacgttcatactgggataggcggggccacccagaggctggccagtgagggcccgcacaccacccacgtgcctccagacagcgagtgacatcccatctcctcctctgcattaaagatgacctgctga

SEQ ID NO: 287335 - DNA, 726 bp, Homo sapiens
  misc_feature (185)..(185): n is a, c, g, or t
atccaaccgtcaaattaagtgttacccccaatattcatgacaagttaatattgccaaaatatccttccaattcggggttaacagacgtgaatttaggttgtttaagacaacccagtttatagcaaatcttattttattcagatagcagtctgatcacacatggtccaacaacactcaaataatanatcaaatataatcagatgttaaagattggggcatgcagctggggttttggctcagaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgtgagtatcagcctcgaggagacacagtagagggcttgagttggctacgttcatactgggataggcggggccacccagaggctggccagtgagggcccgcacaccacccacgtgcctccagacagcgagtgacatcccatctcctcctctgcattaaagatgacctgctga

SEQ ID NO: 287336 - DNA, 2797 bp, Homo sapiens
tttttttggcggtataaaagtgcttctttatttggtcatacagctttcaaatgttgcttaacgaacagatagcatttttataatcagaggaaagactcagtattaaagtgcgcgtcccatcattgcaaccgggccctcgggcagccagctctctcttgcttcgcgtccggctctcaggccctggagctcggcctccctaccttctccaggcgcgggtcctgctccttttccggccgccctcgctccgccccttcgcctctccccgtgatccctctctcgctaaccgtaggcgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctccccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggtaccccgctccaccccacccccacccctgtgacccatgaccctgatgcaggttcagggagtcgaggacgccagatctgagacgctcagaagtctgagcccactggtttatctctgcctctgcggtcctggtcctttgtaaattgccttttgtattttatctgtcttatgccactctgtttgccactctttcatgctcaccccatgctgggatcccatgctgggagctcagtctgcctaggcagataggagagtaaatatatacagtgatgcatttgaggacaggcctattccaggaagctgtgggagcagggtaggcacctaaccctgtctggatcagagaaagctgcttacaggtagtgatgcttggactgtcttcaaggagtgggcattgcttgatgggcaggaagttgagtgttccttgcaagggtgctgtggcaagaggaggcctggtgtatttggcagcgttcctgaggctggacatgtatgtagcctgttgggatggggaggcctggaatgtctgcttggagctggatgtggctaagatcaggggatgatgggaggaggtggacggctcaaagtggggctgattcaaatgtcaaatcctgcagaggccaaacaggctcagaaggaactggcaagaggggatcactactggtcaatggtgggggcagaaaacagatgggaaaaggctaagtagatgcgaggagaggaagtagagacagcagcatggaatacctgagaagggcaagcaaaggtcaggacaatttttaaaggtgagaatttagcaggttacaggttgcggagaaggaccgagggaaggaaaggttttggaaagtactggaggcaggaggcggtgggtggacactgagatgtctgggaaagggcttgcccctcagccatcactgaagtgtctctgaaagtgctgggatacctgggcatcgtgacccaggtgccatggactggagacctggggagacggacgagggctggcacagtcagggaatcctggaagaggtgcagagagagccaagggaggcaaggcctccagtccatcttccccacaggatccacctgatggctggccgagtaccccagggagctgatcgaatagcagtcaaggctgagatggaggccgtttttctggagaacctgaggcatgcagctggggttttggctcaggtgagaaaggtggaaacacacacgtacttacatgtctctgtgggtgtgcggagaagggggtgcacagtggggacagcacgtgaggctgccagcctaggtcagaggaacaggtgagggccttgaccagtgactgactgatgggggacaaacttgggaaggagctctattcacagcacccgacatgctgctaggaggacctcgtgggactgctggagcccatcaacacccgcatcactgacccccagtacttcctggacacgccccagcagggtacgaccccagccctgtctctccttctgtcccttttgattcctgtgctcttgaggctcacggtcccctccctggcttctcttacagcggcagccatcttacagaaggtaggaagacccaacctccaattacaaatggtaagtggaagggggtacttcgcagatcggaaggaggcggggcctgcggggtctcggagcggcagctatccttacagaaggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgtgagtatcagcctcgaggagacacagtagagggcttgagttggctacgttcatactgggataggcggggccacccagaggctggccagtgagggcccgcacaccacccacgtgcctccagacagcgagtgacatcccatctcctcctctgcattaaagatgacctgctga

SEQ ID NO: 287337 - DNA, 2779 bp, Homo sapiens
tttttttggcggtataaaagtgcttctttatttggtcatacagctttcaaatgttgcttaacgaacagatagcatttttataatcagaggaaagactcagtattaaagtgcgcgtcccatcattgcaaccgggccctcgggcagccagctctctcttgcttcgcgtccggctctcaggccctggagctcggcctccctaccttctccaggcgcgggtcctgctccttttccggccgccctcgctccgccccttcgcctctccccgtgatccctctctcgctaaccgtaggcgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctccccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggtaccccgctccaccccacccccacccctgtgacccatgaccctgatgcaggttcagggagtcgaggacgccagatctgagacgctcagaagtctgagcccactggtttatctctgcctctgcggtcctggtcctttgtaaattgccttttgtattttatctgtcttatgccactctgtttgccactctttcatgctcaccccatgctgggatcccatgctgggagctcagtctgcctaggcagataggagagtaaatatatacagtgatgcatttgaggacaggcctattccaggaagctgtgggagcagggtaggcacctaaccctgtctggatcagagaaagctgcttacaggtagtgatgcttggactgtcttcaaggagtgggcattgcttgatgggcaggaagttgagtgttccttgcaagggtgctgtggcaagaggaggcctggtgtatttggcagcgttcctgaggctggacatgtatgtagcctgttgggatggggaggcctggaatgtctgcttggagctggatgtggctaagatcaggggatgatgggaggaggtggacggctcaaagtggggctgattcaaatgtcaaatcctgcagaggccaaacaggctcagaaggaactggcaagaggggatcactactggtcaatggtgggggcagaaaacagatgggaaaaggctaagtagatgcgaggagaggaagtagagacagcagcatggaatacctgagaagggcaagcaaaggtcaggacaatttttaaaggtgagaatttagcaggttacaggttgcggagaaggaccgagggaaggaaaggttttggaaagtactggaggcaggaggcggtgggtggacactgagatgtctgggaaagggcttgcccctcagccatcactgaagtgtctctgaaagtgctgggatacctgggcatcgtgacccaggtgccatggactggagacctggggagacggacgagggctggcacagtcagggaatcctggaagaggtgcagagagagccaagggaggcaaggcctccagtccatcttccccacaggatccacctgatggctggccgagtaccccagggagctgatcgaatagcagtcaaggctgagatggaggccgtttttctggagaacctgaggcatgcagctggggttttggctcaggtgagaaaggtggaaacacacacgtacttacatgtctctgtgggtgtgcggagaagggggtgcacagtggggacagcacgtgaggctgccagcctaggtcagaggaacaggtgagggccttgaccagtgactgactgatgggggacaaacttgggaaggagctctattcacagcacccgacatgctgctaggaggacctcgtgggactgctggagcccatcaacacccgcatcactgacccccagtacttcctggacacgccccagcagggtacgaccccagccctgtctctccttctgtcccttttgattcctgtgctcttgaggctcacggtcccctccctggcttctcttacagcggcagccatcttacagaaggtaggaagacccaacctccaattacaaatggtaagtggaagggggtacttcgcagatcggaaggaggcggggcctgcggggtctcggagcggcagctatccttacagaaggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgagacacagtagagggcttgagttggctacgttcatactgggataggcggggccacccagaggctggccagtgagggcccgcacaccacccacgtgcctccagacagcgagtgacatcccatctcctcctctgcattaaagatgacctgctga

SEQ ID NO: 287338 - DNA, 2939 bp, Homo sapiens
tttttttggcggtataaaagtgcttctttatttggtcatacagctttcaaatgttgcttaacgaacagatagcatttttataatcagaggaaagactcagtattaaagtgcgcgtcccatcattgcaaccgggccctcgggcagccagctctctcttgcttcgcgtccggctctcaggccctggagctcggcctccctaccttctccaggcgcgggtcctgctccttttccggccgccctcgctccgccccttcgcctctccccgtgatccctctctcgctaaccgtaggcgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctccccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggtaccccgctccaccccacccccacccctgtgacccatgaccctgatgcaggttcagggagtcgaggacgccagatctgagacgctcagaagtctgagcccactggtttatctctgcctctgcggtcctggtcctttgtaaattgccttttgtattttatctgtcttatgccactctgtttgccactctttcatgctcaccccatgctgggatcccatgctgggagctcagtctgcctaggcagataggagagtaaatatatacagtgatgcatttgaggacaggcctattccaggaagctgtgggagcagggtaggcacctaaccctgtctggatcagagaaagctgcttacaggtagtgatgcttggactgtcttcaaggagtgggcattgcttgatgggcaggaagttgagtgttccttgcaagggtgctgtggcaagaggaggcctggtgtatttggcagcgttcctgaggctggacatgtatgtagcctgttgggatggggaggcctggaatgtctgcttggagctggatgtggctaagatcaggggatgatgggaggaggtggacggctcaaagtggggctgattcaaatgtcaaatcctgcagaggccaaacaggctcagaaggaactggcaagaggggatcactactggtcaatggtgggggcagaaaacagatgggaaaaggctaagtagatgcgaggagaggaagtagagacagcagcatggaatacctgagaagggcaagcaaaggtcaggacaatttttaaaggtgagaatttagcaggttacaggttgcggagaaggaccgagggaaggaaaggttttggaaagtactggaggcaggaggcggtgggtggacactgagatgtctgggaaagggcttgcccctcagccatcactgaagtgtctctgaaagtgctgggatacctgggcatcgtgacccaggtgccatggactggagacctggggagacggacgagggctggcacagtcagggaatcctggaagaggtgcagagagagccaagggaggcaaggcctccagtccatcttccccacaggatccacctgatggctggccgagtaccccagggagctgatcgaatagcagtcaaggctgagatggaggccgtttttctggagaacctgaggcatgcagctggggttttggctcaggtgagaaaggtggaaacacacacgtacttacatgtctctgtgggtgtgcggagaagggggtgcacagtggggacagcacgtgaggctgccagcctaggtcagaggaacaggtgagggccttgaccagtgactgactgatgggggacaaacttgggaaggagctctattcacagcacccgacatgctgctaggaggacctcgtgggactgctggagcccatcaacacccgcatcactgacccccagtacttcctggacacgccccagcagggtacgaccccagccctgtctctccttctgtcccttttgattcctgtgctcttgaggctcacggtcccctccctggcttctcttacagcggcagccatcttacagaaggtaggaagacccaacctccaattacaaatggtaagtggaagggggtacttcgcagatcggaaggaggcggggcctgcggggtctcggagcggcagctatccttacagaaggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgagacacagtagagggcttgagttggctacgttcatactgggataggcggggccacccagaggctggccagtgagggcccgcacaccacccacgtgcctccagacagcgagtgacatcccatctcctcctctgcattaaagatgacctgctgaacattgtcatatgtctctgtaatggggtggtgggacacatagtgtctaacacttcagtttctctgctgcttccctcccattgagaagccagtgccagggttgctgtgaagatgggagagcttctgaacccacctcattaaaggatgagaaacccagggtc

SEQ ID NO: 287339 - DNA, 2612 bp, Homo sapiens
tttttttggcggtataaaagtgcttctttatttggtcatacagctttcaaatgttgcttaacgaacagatagcatttttataatcagaggaaagactcagtattaaagtgcgcgtcccatcattgcaaccgggccctcgggcagccagctctctcttgcttcgcgtccggctctcaggccctggagctcggcctccctaccttctccaggcgcgggtcctgctccttttccggccgccctcgctccgccccttcgcctctccccgtgatccctctctcgctaaccgtaggcgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctccccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggtaccccgctccaccccacccccacccctgtgacccatgaccctgatgcaggttcagggagtcgaggacgccagatctgagacgctcagaagtctgagcccactggtttatctctgcctctgcggtcctggtcctttgtaaattgccttttgtattttatctgtcttatgccactctgtttgccactctttcatgctcaccccatgctgggatcccatgctgggagctcagtctgcctaggcagataggagagtaaatatatacagtgatgcatttgaggacaggcctattccaggaagctgtgggagcagggtaggcacctaaccctgtctggatcagagaaagctgcttacaggtagtgatgcttggactgtcttcaaggagtgggcattgcttgatgggcaggaagttgagtgttccttgcaagggtgctgtggcaagaggaggcctggtgtatttggcagcgttcctgaggctggacatgtatgtagcctgttgggatggggaggcctggaatgtctgcttggagctggatgtggctaagatcaggggatgatgggaggaggtggacggctcaaagtggggctgattcaaatgtcaaatcctgcagaggccaaacaggctcagaaggaactggcaagaggggatcactactggtcaatggtgggggcagaaaacagatgggaaaaggctaagtagatgcgaggagaggaagtagagacagcagcatggaatacctgagaagggcaagcaaaggtcaggacaatttttaaaggtgagaatttagcaggttacaggttgcggagaaggaccgagggaaggaaaggttttggaaagtactggaggcaggaggcggtgggtggacactgagatgtctgggaaagggcttgcccctcagccatcactgaagtgtctctgaaagtgctgggatacctgggcatcgtgacccaggtgccatggactggagacctggggagacggacgagggctggcacagtcagggaatcctggaagaggtgcagagagagccaagggaggcaaggcctccagtccatcttccccacaggatccacctgatggctggccgagtaccccagggagctgatcgaatagcagtcaaggctgagatggaggccgtttttctggagaacctgaggcatgcagctggggttttggctcaggtgagaaaggtggaaacacacacgtacttacatgtctctgtgggtgtgcggagaagggggtgcacagtggggacagcacgtgaggctgccagcctaggtcagaggaacaggtgagggccttgaccagtgactgactgatgggggacaaacttgggaaggagctctattcacagcacccgacatgctgctaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgagacacagtagagggcttgagttggctacgttcatactgggataggcggggccacccagaggctggccagtgagggcccgcacaccacccacgtgcctccagacagcgagtgacatcccatctcctcctctgcattaaagatgacctgctga

SEQ ID NO: 287340 - DNA, 2601 bp, Homo sapiens
tttttttggcggtataaaagtgcttctttatttggtcatacagctttcaaatgttgcttaacgaacagatagcatttttataatcagaggaaagactcagtattaaagtgcgcgtcccatcattgcaaccgggccctcgggcagccagctctctcttgcttcgcgtccggctctcaggccctggagctcggcctccctaccttctccaggcgcgggtcctgctccttttccggccgccctcgctccgccccttcgcctctccccgtgatccctctctcgctaaccgtaggcgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctccccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggtaccccgctccaccccacccccacccctgtgacccatgaccctgatgcaggttcagggagtcgaggacgccagatctgagacgctcagaagtctgagcccactggtttatctctgcctctgcggtcctggtcctttgtaaattgccttttgtattttatctgtcttatgccactctgtttgccactctttcatgctcaccccatgctgggatcccatgctgggagctcagtctgcctaggcagataggagagtaaatatatacagtgatgcatttgaggacaggcctattccaggaagctgtgggagcagggtaggcacctaaccctgtctggatcagagaaagctgcttacaggtagtgatgcttggactgtcttcaaggagtgggcattgcttgatgggcaggaagttgagtgttccttgcaagggtgctgtggcaagaggaggcctggtgtatttggcagcgttcctgaggctggacatgtatgtagcctgttgggatggggaggcctggaatgtctgcttggagctggatgtggctaagatcaggggatgatgggaggaggtggacggctcaaagtggggctgattcaaatgtcaaatcctgcagaggccaaacaggctcagaaggaactggcaagaggggatcactactggtcaatggtgggggcagaaaacagatgggaaaaggctaagtagatgcgaggagaggaagtagagacagcagcatggaatacctgagaagggcaagcaaaggtcaggacaatttttaaaggtgagaatttagcaggttacaggttgcggagaaggaccgagggaaggaaaggttttggaaagtactggaggcaggaggcggtgggtggacactgagatgtctgggaaagggcttgcccctcagccatcactgaagtgtctctgaaagtgctgggatacctgggcatcgtgacccaggtgccatggactggagacctggggagacggacgagggctggcacagtcagggaatcctggaagaggtgcagagagagccaagggaggcaaggcctccagtccatcttccccacaggatccacctgatggctggccgagtaccccagggagctgatcgaatagcagtcaaggctgagatggaggccgtttttctggagaacctgaggcatgcagctggggttttggctcaggtgagaaaggtggaaacacacacgtacttacatgtctctgtgggtgtgcggagaagggggtgcacagtggggacagcacgtgaggctgccagcctaggtcagaggaacaggtgagggccttgaccagtgactgactgatgggggacaaacttgggaaggagctctattcacagcacccgacatgctgctaggaggacctcgtgggactgctggagcccatcaacacccgcatcactgacccccagtacttcctggacacgccccagcaggcggcagctatccttacagaaggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgtgagtatcagcctcgaggagacacagtagagggcttgagttggctacgttcatactgggataggcggggccacccagaggctggccagtgagggcccgcacaccacccacgtgcctccagacagcgagtgacatcccatctcctcctctgcattaaagatgacctgctga

SEQ ID NO: 287341 - DNA, 3025 bp, Homo sapiens
tacaggttttaaaaatgtgtttttattaaatataagacagataaaaaatgatatttataaaatatatgttagctctaaagaagagtagtaaaattaacatacatgaatgtgctatccaacgtaagagaaggctccaatgctaccctcttctgtcctcctctagaggtggtcaccattatgctgaattttgtgataattattcacttgttcttcattgttttatcagagatgtccatattcctacacaagatactgttggttttccctgcctttgactttatatcaatggaatcacactgtaggtatttctctgtgatttgcttgttcctctagagattatgtttctgagatttatccacttgatgctttcatactgatgtttttcagttccaatcaaacttcactaagctcttcatatattgtcctaccttctccaggcgcgggtcctgctccttttccggccgccctcgctccgccccttcgcctctccccgtgatccctctctcgctaaccgtaggcgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctccccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggtaccccgctccaccccacccccacccctgtgacccatgaccctgatgcaggttcagggagtcgaggacgccagatctgagacgctcagaagtctgagcccactggtttatctctgcctctgcggtcctggtcctttgtaaattgccttttgtattttatctgtcttatgccactctgtttgccactctttcatgctcaccccatgctgggatcccatgctgggagctcagtctgcctaggcagataggagagtaaatatatacagtgatgcatttgaggacaggcctattccaggaagctgtgggagcagggtaggcacctaaccctgtctggatcagagaaagctgcttacaggtagtgatgcttggactgtcttcaaggagtgggcattgcttgatgggcaggaagttgagtgttccttgcaagggtgctgtggcaagaggaggcctggtgtatttggcagcgttcctgaggctggacatgtatgtagcctgttgggatggggaggcctggaatgtctgcttggagctggatgtggctaagatcaggggatgatgggaggaggtggacggctcaaagtggggctgattcaaatgtcaaatcctgcagaggccaaacaggctcagaaggaactggcaagaggggatcactactggtcaatggtgggggcagaaaacagatgggaaaaggctaagtagatgcgaggagaggaagtagagacagcagcatggaatacctgagaagggcaagcaaaggtcaggacaatttttaaaggtgagaatttagcaggttacaggttgcggagaaggaccgagggaaggaaaggttttggaaagtactggaggcaggaggcggtgggtggacactgagatgtctgggaaagggcttgcccctcagccatcactgaagtgtctctgaaagtgctgggatacctgggcatcgtgacccaggtgccatggactggagacctggggagacggacgagggctggcacagtcagggaatcctggaagaggtgcagagagagccaagggaggcaaggcctccagtccatcttccccacaggatccacctgatggctggccgagtaccccagggagctgatcgaatagcagtcaaggctgagatggaggccgtttttctggagaacctgaggcatgcagctggggttttggctcaggtgagaaaggtggaaacacacacgtacttacatgtctctgtgggtgtgcggagaagggggtgcacagtggggacagcacgtgaggctgccagcctaggtcagaggaacaggtgagggccttgaccagtgactgactgatgggggacaaacttgggaaggagctctattcacagcacccgacatgctgctaggaggacctcgtgggactgctggagcccatcaacacccgcatcactgacccccagtacttcctggacacgccccagcagggtacgaccccagccctgtctctccttctgtcccttttgattcctgtgctcttgaggctcacggtcccctccctggcttctcttacagcggcagccatcttacagaaggtaggaagacccaacctccaattacaaatggtaagtggaagggggtacttcgcagatcggaaggaggcggggcctgcggggtctcggagcggcagctatccttacagaaggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgtgagtatcagcctcgaggagacacagtagagggcttgagttggctacgttcatactgggataggcggggccacccagaggctggccagtgagggcccgcacaccacccacgtgcctccagacagcgagtgacatcccatctcctcctctgcattaaagatgacctgctga

SEQ ID NO: 287342 - DNA, 2421 bp, Homo sapiens
tttttttggcggtataaaagtgcttctttatttggtcatacagctttcaaatgttgcttaacgaacagatagcatttttataatcagaggaaagactcagtattaaagtgcgcgtcccatcattgcaaccgggccctcgggcagccagctctctcttgcttcgcgtccggctctcaggccctggagctcggcctccctaccttctccaggcgcgggtcctgctccttttccggccgccctcgctccgccccttcgcctctccccgtgatccctctctcgctaaccgtaggcgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctccccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggtaccccgctccaccccacccccacccctgtgacccatgaccctgatgcaggttcagggagtcgaggacgccagatctgagacgctcagaagtctgagcccactggtttatctctgcctctgcggtcctggtcctttgtaaattgccttttgtattttatctgtcttatgccactctgtttgccactctttcatgctcaccccatgctgggatcccatgctgggagctcagtctgcctaggcagataggagagtaaatatatacagtgatgcatttgaggacaggcctattccaggaagctgtgggagcagggtaggcacctaaccctgtctggatcagagaaagctgcttacaggtagtgatgcttggactgtcttcaaggagtgggcattgcttgatgggcaggaagttgagtgttccttgcaagggtgctgtggcaagaggaggcctggtgtatttggcagcgttcctgaggctggacatgtatgtagcctgttgggatggggaggcctggaatgtctgcttggagctggatgtggctaagatcaggggatgatgggaggaggtggacggctcaaagtggggctgattcaaatgtcaaatcctgcagaggccaaacaggctcagaaggaactggcaagaggggatcactactggtcaatggtgggggcagaaaacagatgggaaaaggctaagtagatgcgaggagaggaagtagagacagcagcatggaatacctgagaagggcaagcaaaggtcaggacaatttttaaaggtgagaatttagcaggttacaggttgcggagaaggaccgagggaaggaaaggttttggaaagtactggaggcaggaggcggtgggtggacactgagatgtctgggaaagggcttgcccctcagccatcactgaagtgtctctgaaagtgctgggatacctgggcatcgtgacccaggtgccatggactggagacctggggagacggacgagggctggcacagtcagggaatcctggaagaggtgcagagagagccaagggaggcaaggcctccagtccatcttccccacaggatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgagacacagtagagggcttgagttggctacgttcatactgggataggcggggccacccagaggctggccagtgagggcccgcacaccacccacgtgcctccagacagcgagtgacatcccatctcctcctctgcattaaagatgacctgctga

SEQ ID NO: 287343 - DNA, 2391 bp, Homo sapiens
tttttttggcggtataaaagtgcttctttatttggtcatacagctttcaaatgttgcttaacgaacagatagcatttttataatcagaggaaagactcagtattaaagtgcgcgtcccatcattgcaaccgggccctcgggcagccagctctctcttgcttcgcgtccggctctcaggccctggagctcggcctccctaccttctccaggcgcgggtcctgctccttttccggccgccctcgctccgccccttgagaccaagagaagggggaaatggggctgggggccgtccccgggagacaggcggccttccgagagggactggagcaggccgtgcggtatgccaaagccctgggctgtcccaggtaccccgctccaccccacccccacccctgtgacccatgaccctgatgcaggttcagggagtcgaggacgccagatctgagacgctcagaagtctgagcccactggtttatctctgcctctgcggtcctggtcctttgtaaattgccttttgtattttatctgtcttatgccactctgtttgccactctttcatgctcaccccatgctgggatcccatgctgggagctcagtctgcctaggcagataggagagtaaatatatacagtgatgcatttgaggacaggcctattccaggaagctgtgggagcagggtaggcacctaaccctgtctggatcagagaaagctgcttacaggtagtgatgcttggactgtcttcaaggagtgggcattgcttgatgggcaggaagttgagtgttccttgcaagggtgctgtggcaagaggaggcctggtgtatttggcagcgttcctgaggctggacatgtatgtagcctgttgggatggggaggcctggaatgtctgcttggagctggatgtggctaagatcaggggatgatgggaggaggtggacggctcaaagtggggctgattcaaatgtcaaatcctgcagaggccaaacaggctcagaaggaactggcaagaggggatcactactggtcaatggtgggggcagaaaacagatgggaaaaggctaagtagatgcgaggagaggaagtagagacagcagcatggaatacctgagaagggcaagcaaaggtcaggacaatttttaaaggtgagaatttagcaggttacaggttgcggagaaggaccgagggaaggaaaggttttggaaagtactggaggcaggaggcggtgggtggacactgagatgtctgggaaagggcttgcccctcagccatcactgaagtgtctctgaaagtgctgggatacctgggcatcgtgacccaggtgccatggactggagacctggggagacggacgagggctggcacagtcagggaatcctggaagaggtgcagagagagccaagggaggcaaggcctccagtccatcttccccacaggatccacctgatggctggccgagtaccccagggagctgatcgaatagcagtcaaggctgagatggaggccgtttttctggagaacctgaggcatgcagctggggttttggctcaggtgagaaaggtggaaacacacacgtacttacatgtctctgtgggtgtgcggagaagggggtgcacagtggggacagcacgtgaggctgccagcctaggtcagaggaacaggtgagggccttgaccagtgactgactgatgggggacaaacttgggaaggagctctattcacagcacccgacatgctgctaggaggacctcgtgggactgctggagcccatcaacacccgcatcactgacccccagtacttcctggacacgccccagcagggtacgaccccagccctgtctctccttctgtcccttttgattcctgtgctcttgaggctcacggtcccctccctggcttctcttacagcggcagccatcttacagaaggtaggaagacccaacctccaattacaaatggtaagtggaagggggtacttcgcagatcggaaggaggcggggcctgcggggtctcggagcggcagctatccttacagaaggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgtgagtatcagcctcgaggagacacagtagagggcttgagttggctacgttcatactgggataggcggggccacccagaggctggccagtgagggcccgcacaccacccacgtgcctccagacagcgagtgacatcccatctcctcctctgcattaaagatgacctgctga

SEQ ID NO: 287344 - DNA, 2364 bp, Homo sapiens
aatgccaggctggtccggtcggaggtgttatgatcgctgcgcttctccgccaatctgtcctggctattccccgagctccccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggtaccccgctccaccccacccccacccctgtgacccatgaccctgatgcaggttcagggagtcgaggacgccagatctgagacgctcagaagtctgagcccactggtttatctctgcctctgcggtcctggtcctttgtaaattgccttttgtattttatctgtcttatgccactctgtttgccactctttcatgctcaccccatgctgggatcccatgctgggagctcagtctgcctaggcagataggagagtaaatatatacagtgatgcatttgaggacaggcctattccaggaagctgtgggagcagggtaggcacctaaccctgtctggatcagagaaagctgcttacaggtagtgatgcttggactgtcttcaaggagtgggcattgcttgatgggcaggaagttgagtgttccttgcaagggtgctgtggcaagaggaggcctggtgtatttggcagcgttcctgaggctggacatgtatgtagcctgttgggatggggaggcctggaatgtctgcttggagctggatgtggctaagatcaggggatgatgggaggaggtggacggctcaaagtggggctgattcaaatgtcaaatcctgcagaggccaaacaggctcagaaggaactggcaagaggggatcactactggtcaatggtgggggcagaaaacagatgggaaaaggctaagtagatgcgaggagaggaagtagagacagcagcatggaatacctgagaagggcaagcaaaggtcaggacaatttttaaaggtgagaatttagcaggttacaggttgcggagaaggaccgagggaaggaaaggttttggaaagtactggaggcaggaggcggtgggtggacactgagatgtctgggaaagggcttgcccctcagccatcactgaagtgtctctgaaagtgctgggatacctgggcatcgtgacccaggtgccatggactggagacctggggagacggacgagggctggcacagtcagggaatcctggaagaggtgcagagagagccaagggaggcaaggcctccagtccatcttccccacaggatccacctgatggctggccgagtaccccagggagctgatcgaatagcagtcaaggctgagatggaggccgtttttctggagaacctgaggcatgcagctggggttttggctcaggtgagaaaggtggaaacacacacgtacttacatgtctctgtgggtgtgcggagaagggggtgcacagtggggacagcacgtgaggctgccagcctaggtcagaggaacaggtgagggccttgaccagtgactgactgatgggggacaaacttgggaaggagctctattcacagcacccgacatgctgctaggaggacctcgtgggactgctggagcccatcaacacccgcatcactgacccccagtacttcctggacacgccccagcagggtacgaccccagccctgtctctccttctgtcccttttgattcctgtgctcttgaggctcacggtcccctccctggcttctcttacagcggcagccatcttacagaaggtaggaagacccaacctccaattacaaatggtaagtggaagggggtacttcgcagatcggaaggaggcggggcctgcggggtctcggagcggcagctatccttacagaaggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgtgagtatcagcctcgaggagacacagtagagggcttgagttggctacgttcatactgggataggcggggccacccagaggctggccagtgagggcccgcacaccacccacgtgcctccagacagcgagtgacatcccatctcctcctctgcattaaagatgacctgctga

SEQ ID NO: 287345 - DNA, 1639 bp, Homo sapiens
gcggccgcctactactactaaattcgcggccgcgtcgacgggtgctgtggcaagaggaggcctggtgtatttggcagcgttcctgaggctggacatgtatgtagcctgttgggatggggaggcctggaatgtctgcttggagctggatgtggctaagatcaggggatgatgggaggaggtggacggctcaaagtggggctgattcaaatgtcaaatcctgcagaggccaaacaggctcagaaggaactggcaagaggggatcactactggtcaatggtgggggcagaaaacagatgggaaaaggctaagtagatgcgaggagaggaagtagagacagcagcatggaatacctgagaagggcaagcaaaggtcaggacaatttttaaaggtgagaatttagcaggttacaggttgcggagaaggaccgagggaaggaaaggttttggaaagtactggaggcaggaggcggtgggtggacactgagatgtctgggaaagggcttgcccctcagccatcactgaagtgtctctgaaagtgctgggatacctgggcatcgtgacccaggtgccatggactggagacctggggagacggacgagggctggcacagtcagggaatcctggaagaggtgcagagagagccaagggaggcaaggcctccagtccatcttccccacaggatccacctgatggctggccgagtaccccagggagctgatcgaatagcagtcaaggctgagatggaggccgtttttctggagaacctgaggcatgcagctggggttttggctcaggtgagaaaggtggaaacacacacgtacttacatgtctctgtgggtgtgcggagaagggggtgcacagtggggacagcacgtgaggctgccagcctaggtcagaggaacaggtgagggccttgaccagtgactgactgatgggggacaaacttgggaaggagctctattcacagcacccgacatgctgctaggaggacctcgtgggactgctggagcccatcaacacccgcatcactgacccccagtacttcctggacacgccccagcagggtacgaccccagccctgtctctccttctgtcccttttgattcctgtgctcttgaggctcacggtcccctccctggcttctcttacagcggcagccatcttacagaaggtaggaagacccaacctccaattacaaatggtaagtggaagggggtacttcgcagatcggaaggaggcggggcctgcggggtctcggagcggcagctatccttacagaaggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgtgagtatcagcctcgaggagacacagtagagggcttgagttggctacgttcatactgggataggcggggccacccagaggctggccagtgagggcccgcacaccacccacgtgcctccagacagcgagtgacatcccatctcctcctctgcattaaagatgacctgctga

SEQ ID NO: 287346 - DNA, 1325 bp, Homo sapiens
tttttttggcggtataaaagtgcttctttatttggtcatacagctttcaaatgttgcttaacgaacagatagcatttttataatcagaggaaagactcagtattaaagtgcgcgtcccatcattgcaaccgggccctcgggcagccagctctctcttgcttcgcgtccggctctcaggccctggagctcggcctccctaccttctccaggcgcgggtcctgctccttttccggccgccctcgctccgccccttcgcctctccccgtgatccctctctcgctaaccgtaggcgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctccccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgagacacagtagagggcttgagttggctacgttcatactgggataggcggggccacccagaggctggccagtgagggcccgcacaccacccacgtgcctccagacagcgagtgacatcccatctcctcctctgcattaaagatgacctgctga

SEQ ID NO: 287347 - DNA, 864 bp, Homo sapiens
tttttttggcggtataaaagtgcttctttatttggtcatacagctttcaaatgttgcttaacgaacagatagcatttttataatcagaggaaagactcagtattaaagtgcgcgtcccatcattgcaaccgggccctcgggcagccagctctctcttgcttcgcgtccggctctcaggccctggagctcggcctccctaccttctccaggcgcgggtcctgctccttttccggccgccctcgctccgccccttcgcctctccccgtgatccctctctcgctaaccgtaggcgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctccccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgttcatactgggataggcggggccacccagaggctggccagtgagggcccgcacaccacccacgtgcctccagacagcgagtgacatcccatctcctcctctgcattaaagatgacctgctga

SEQ ID NO: 287348 - DNA, 814 bp, Homo sapiens
atctgaggaccccccgagtagtcccatcattgcaaccgggccctcgggcagccagctctctcttgcttcgcgtccggctctcaggccctggagctcggcctccaacctgaggcatgcagctggggttttggctcaggtgagaaaggtggaaacacacacgtacttacatgtctctgtgggtgtgcggagaagggggtgcacagtggggacagcacgtgaggctgccagcctaggtcagaggaacaggtgagggccttgaccagtgactgactgatgggggacaaacttgggaaggagctctattcacagcacccgacatgctgctaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgtgagtatcagcctcgaggagacacagtagagggcttgagttggctacgttcatactgggataggcggggccacccagaggctggccagtgagggcccgcacaccacccacgtgcctccagacagcgagtgacatcccatctcctcctctgcattaaagatgacctgctga

SEQ ID NO: 287349 - DNA, 949 bp, Homo sapiens
tttttttggcggtataaaagtgcttctttatttggtcatacagctttcaaatgttgcttaacgaacagatagcatttttataatcagaggaaagactcagtattaaagtgcgcgtcccatcattgcaaccgggccctcgggcagccagctctctcttgcttcgcgtccggctctcaggccctggagctcggcctccctaccttctccaggcgcgggtcctgctccttttccggccgccctcgctccgccccttgagaccaagagaagggggaaatggggctgggggccgtccccgggagacaggcggccttccgagagggactggagcaggccgtgcggtatgccaaagccctgggctgtcccaggatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgagacacagtagagggcttgagttggctacgttcatactgggataggcggggccacccagaggctggccagtgagggcccgcacaccacccacgtgcctccagacagcgagtgacatcccatctcctcctctgcattaaagatgacctgctga

SEQ ID NO: 287350 - DNA, 329 bp, Homo sapiens
tttttttggcggtataaaagtgcttctttatttggtcatacagctttcaaatgttgcttaacgaacagatagcatttttataatcagaggaaagactcagtattaaagtgcgcgtcccatcattgcaaccgggccctcgggcagccagctctctcttgcttcgcgtccggctggaagaatttgttgagagtgatgggcagctgcacagacacgttctggaaggtgcccccatacctgaactgaatgttgaggactggcgcctccgtgaagtcggacacgcactctatgttgaccacctgctgcacctgcgcgccccttcgcctctcccc

SEQ ID NO: 287351 - DNA, 1373 bp, Homo sapiens
tttttttggcggtataaaagtgcttctttatttggtcatacagctttcaaatgttgcttaacgaacagatagcatttttataatcagaggaaagactcagtattaaagtgcgcgtcccatcattgcaaccgggccctcgggcagccagctctctcttgcttcgcgtccggctctcaggccctggagctcggcctccctaccttctccaggcgcgggtcctgctccttttccggccgccctcgctccgccccttcgcctctccccgtgatccctctctcgctaaccgtaggcgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctccccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgtgagtatcagcctcgaggagacacagtagagggcttgagttggctacgttcatactgggataggcggggccacccagaggctggccagtgagggcccgcacaccacccacgtgcctccagacagcgagtgacatcccatctcctcctctgcattaaagatgacctgctga

SEQ ID NO: 287352 - DNA, 2699 bp, Homo sapiens
tttttttggcggtataaaagtgcttctttatttggtcatacagctttcaaatgttgcttaacgaacagatagcatttttataatcagaggaaagactcagtattaaagtgcgcgtcccatcattgcaaccgggccctcgggcagccagctctctcttgcttcgcgtccggctctcaggccctggagctcggcctccctaccttctccaggcgcgggtcctgctccttttccggccgccctcgctccgccccttcgcctctccccgtgatccctctctcgctaaccgtaggcgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctccccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggtaccccgctccaccccacccccacccctgtgacccatgaccctgatgcaggttcagggagtcgaggacgccagatctgagacgctcagaagtctgagcccactggtttatctctgcctctgcggtcctggtcctttgtaaattgccttttgtattttatctgtcttatgccactctgtttgccactctttcatgctcaccccatgctgggatcccatgctgggagctcagtctgcctaggcagataggagagtaaatatatacagtgatgcatttgaggacaggcctattccaggaagctgtgggagcagggtaggcacctaaccctgtctggatcagagaaagctgcttacaggtagtgatgcttggactgtcttcaaggagtgggcattgcttgatgggcaggaagttgagtgttccttgcaagggtgctgtggcaagaggaggcctggtgtatttggcagcgttcctgaggctggacatgtatgtagcctgttgggatggggaggcctggaatgtctgcttggagctggatgtggctaagatcaggggatgatgggaggaggtggacggctcaaagtggggctgattcaaatgtcaaatcctgcagaggccaaacaggctcagaaggaactggcaagaggggatcactactggtcaatggtgggggcagaaaacagatgggaaaaggctaagtagatgcgaggagaggaagtagagacagcagcatggaatacctgagaagggcaagcaaaggtcaggacaatttttaaaggtgagaatttagcaggttacaggttgcggagaaggaccgagggaaggaaaggttttggaaagtactggaggcaggaggcggtgggtggacactgagatgtctgggaaagggcttgcccctcagccatcactgaagtgtctctgaaagtgctgggatacctgggcatcgtgacccaggtgccatggactggagacctggggagacggacgagggctggcacagtcagggaatcctggaagaggtgcagagagagccaagggaggcaaggcctccagtccatcttccccacaggatccacctgatggctggccgagtaccccagggagctgatcgaatagcagtcaaggctgagatggaggccgtttttctggagaacctgaggcatgcagctggggttttggctcaggtgagaaaggtggaaacacacacgtacttacatgtctctgtgggtgtgcggagaagggggtgcacagtggggacagcacgtgaggctgccagcctaggtcagaggaacaggtgagggccttgaccagtgactgactgatgggggacaaacttgggaaggagctctattcacagcacccgacatgctgctaggaggacctcgtgggactgctggagcccatcaacacccgcatcactgacccccagtacttcctggacacgccccagcagggtacgaccccagccctgtctctccttctgtcccttttgattcctgtgctcttgaggctcacggtcccctccctggcttctcttacagcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgagacacagtagagggcttgagttggctacgttcatactgggataggcggggccacccagaggctggccagtgagggcccgcacaccacccacgtgcctccagacagcgagtgacatcccatctcctcctctgcattaaagatgacctgctga

SEQ ID NO: 287353 - DNA, 2859 bp, Homo sapiens
tttttttggcggtataaaagtgcttctttatttggtcatacagctttcaaatgttgcttaacgaacagatagcatttttataatcagaggaaagactcagtattaaagtgcgcgtcccatcattgcaaccgggccctcgggcagccagctctctcttgcttcgcgtccggctctcaggccctggagctcggcctccctaccttctccaggcgcgggtcctgctccttttccggccgccctcgctccgccccttcgcctctccccgtgatccctctctcgctaaccgtaggcgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctccccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggtaccccgctccaccccacccccacccctgtgacccatgaccctgatgcaggttcagggagtcgaggacgccagatctgagacgctcagaagtctgagcccactggtttatctctgcctctgcggtcctggtcctttgtaaattgccttttgtattttatctgtcttatgccactctgtttgccactctttcatgctcaccccatgctgggatcccatgctgggagctcagtctgcctaggcagataggagagtaaatatatacagtgatgcatttgaggacaggcctattccaggaagctgtgggagcagggtaggcacctaaccctgtctggatcagagaaagctgcttacaggtagtgatgcttggactgtcttcaaggagtgggcattgcttgatgggcaggaagttgagtgttccttgcaagggtgctgtggcaagaggaggcctggtgtatttggcagcgttcctgaggctggacatgtatgtagcctgttgggatggggaggcctggaatgtctgcttggagctggatgtggctaagatcaggggatgatgggaggaggtggacggctcaaagtggggctgattcaaatgtcaaatcctgcagaggccaaacaggctcagaaggaactggcaagaggggatcactactggtcaatggtgggggcagaaaacagatgggaaaaggctaagtagatgcgaggagaggaagtagagacagcagcatggaatacctgagaagggcaagcaaaggtcaggacaatttttaaaggtgagaatttagcaggttacaggttgcggagaaggaccgagggaaggaaaggttttggaaagtactggaggcaggaggcggtgggtggacactgagatgtctgggaaagggcttgcccctcagccatcactgaagtgtctctgaaagtgctgggatacctgggcatcgtgacccaggtgccatggactggagacctggggagacggacgagggctggcacagtcagggaatcctggaagaggtgcagagagagccaagggaggcaaggcctccagtccatcttccccacaggatccacctgatggctggccgagtaccccagggagctgatcgaatagcagtcaaggctgagatggaggccgtttttctggagaacctgaggcatgcagctggggttttggctcaggtgagaaaggtggaaacacacacgtacttacatgtctctgtgggtgtgcggagaagggggtgcacagtggggacagcacgtgaggctgccagcctaggtcagaggaacaggtgagggccttgaccagtgactgactgatgggggacaaacttgggaaggagctctattcacagcacccgacatgctgctaggaggacctcgtgggactgctggagcccatcaacacccgcatcactgacccccagtacttcctggacacgccccagcagggtacgaccccagccctgtctctccttctgtcccttttgattcctgtgctcttgaggctcacggtcccctccctggcttctcttacagcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgagacacagtagagggcttgagttggctacgttcatactgggataggcggggccacccagaggctggccagtgagggcccgcacaccacccacgtgcctccagacagcgagtgacatcccatctcctcctctgcattaaagatgacctgctgaacattgtcatatgtctctgtaatggggtggtgggacacatagtgtctaacacttcagtttctctgctgcttccctcccattgagaagccagtgccagggttgctgtgaagatgggagagcttctgaacccacctcattaaaggatgagaaacccagggtc

SEQ ID NO: 287354 - DNA, 2772 bp, Homo sapiens
tttttttggcggtataaaagtgcttctttatttggtcatacagctttcaaatgttgcttaacgaacagatagcatttttataatcagaggaaagactcagtattaaagtgcgcgtcccatcattgcaaccgggccctcgggcagccagctctctcttgcttcgcgtccggctctcaggccctggagctcggcctccctaccttctccaggcgcgggtcctgctccttttccggccgccctcgctccgccccttcgcctctccccgtgatccctctctcgctaaccgtaggcgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctccccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggtaccccgctccaccccacccccacccctgtgacccatgaccctgatgcaggttcagggagtcgaggacgccagatctgagacgctcagaagtctgagcccactggtttatctctgcctctgcggtcctggtcctttgtaaattgccttttgtattttatctgtcttatgccactctgtttgccactctttcatgctcaccccatgctgggatcccatgctgggagctcagtctgcctaggcagataggagagtaaatatatacagtgatgcatttgaggacaggcctattccaggaagctgtgggagcagggtaggcacctaaccctgtctggatcagagaaagctgcttacaggtagtgatgcttggactgtcttcaaggagtgggcattgcttgatgggcaggaagttgagtgttccttgcaagggtgctgtggcaagaggaggcctggtgtatttggcagcgttcctgaggctggacatgtatgtagcctgttgggatggggaggcctggaatgtctgcttggagctggatgtggctaagatcaggggatgatgggaggaggtggacggctcaaagtggggctgattcaaatgtcaaatcctgcagaggccaaacaggctcagaaggaactggcaagaggggatcactactggtcaatggtgggggcagaaaacagatgggaaaaggctaagtagatgcgaggagaggaagtagagacagcagcatggaatacctgagaagggcaagcaaaggtcaggacaatttttaaaggtgagaatttagcaggttacaggttgcggagaaggaccgagggaaggaaaggttttggaaagtactggaggcaggaggcggtgggtggacactgagatgtctgggaaagggcttgcccctcagccatcactgaagtgtctctgaaagtgctgggatacctgggcatcgtgacccaggtgccatggactggagacctggggagacggacgagggctggcacagtcagggaatcctggaagaggtgcagagagagccaagggaggcaaggcctccagtccatcttccccacaggatccacctgatggctggccgagtaccccagggagctgatcgaatagcagtcaaggctgagatggaggccgtttttctggagaacctgaggcatgcagctggggttttggctcaggtgagaaaggtggaaacacacacgtacttacatgtctctgtgggtgtgcggagaagggggtgcacagtggggacagcacgtgaggctgccagcctaggtcagaggaacaggtgagggccttgaccagtgactgactgatgggggacaaacttgggaaggagctctattcacagcacccgacatgctgctaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgagacacagtagagggcttgagttggctacgttcatactgggataggcggggccacccagaggctggccagtgagggcccgcacaccacccacgtgcctccagacagcgagtgacatcccatctcctcctctgcattaaagatgacctgctgaacattgtcatatgtctctgtaatggggtggtgggacacatagtgtctaacacttcagtttctctgctgcttccctcccattgagaagccagtgccagggttgctgtgaagatgggagagcttctgaacccacctcattaaaggatgagaaacccagggtc

SEQ ID NO: 287355 - DNA, 2581 bp, Homo sapiens
tttttttggcggtataaaagtgcttctttatttggtcatacagctttcaaatgttgcttaacgaacagatagcatttttataatcagaggaaagactcagtattaaagtgcgcgtcccatcattgcaaccgggccctcgggcagccagctctctcttgcttcgcgtccggctctcaggccctggagctcggcctccctaccttctccaggcgcgggtcctgctccttttccggccgccctcgctccgccccttcgcctctccccgtgatccctctctcgctaaccgtaggcgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctccccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggtaccccgctccaccccacccccacccctgtgacccatgaccctgatgcaggttcagggagtcgaggacgccagatctgagacgctcagaagtctgagcccactggtttatctctgcctctgcggtcctggtcctttgtaaattgccttttgtattttatctgtcttatgccactctgtttgccactctttcatgctcaccccatgctgggatcccatgctgggagctcagtctgcctaggcagataggagagtaaatatatacagtgatgcatttgaggacaggcctattccaggaagctgtgggagcagggtaggcacctaaccctgtctggatcagagaaagctgcttacaggtagtgatgcttggactgtcttcaaggagtgggcattgcttgatgggcaggaagttgagtgttccttgcaagggtgctgtggcaagaggaggcctggtgtatttggcagcgttcctgaggctggacatgtatgtagcctgttgggatggggaggcctggaatgtctgcttggagctggatgtggctaagatcaggggatgatgggaggaggtggacggctcaaagtggggctgattcaaatgtcaaatcctgcagaggccaaacaggctcagaaggaactggcaagaggggatcactactggtcaatggtgggggcagaaaacagatgggaaaaggctaagtagatgcgaggagaggaagtagagacagcagcatggaatacctgagaagggcaagcaaaggtcaggacaatttttaaaggtgagaatttagcaggttacaggttgcggagaaggaccgagggaaggaaaggttttggaaagtactggaggcaggaggcggtgggtggacactgagatgtctgggaaagggcttgcccctcagccatcactgaagtgtctctgaaagtgctgggatacctgggcatcgtgacccaggtgccatggactggagacctggggagacggacgagggctggcacagtcagggaatcctggaagaggtgcagagagagccaagggaggcaaggcctccagtccatcttccccacaggatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgagacacagtagagggcttgagttggctacgttcatactgggataggcggggccacccagaggctggccagtgagggcccgcacaccacccacgtgcctccagacagcgagtgacatcccatctcctcctctgcattaaagatgacctgctgaacattgtcatatgtctctgtaatggggtggtgggacacatagtgtctaacacttcagtttctctgctgcttccctcccattgagaagccagtgccagggttgctgtgaagatgggagagcttctgaacccacctcattaaaggatgagaaacccagggtc

SEQ ID NO: 287356 - DNA, 1355 bp, Homo sapiens
tttttttggcggtataaaagtgcttctttatttggtcatacagctttcaaatgttgcttaacgaacagatagcatttttataatcagaggaaagactcagtattaaagtgcgcgtcccatcattgcaaccgggccctcgggcagccagctctctcttgcttcgcgtccggctctcaggccctggagctcggcctccctaccttctccaggcgcgggtcctgctccttttccggccgccctcgctccgccccttcgcctctccccgtgatccctctctcgctaaccgtaggcgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctccccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgcggtatgccaaagccctgggctgtcccaggatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgagacacagtagagggcttgagttggctacgttcatactgggataggcggggccacccagaggctggccagtgagggcccgcacaccacccacgtgcctccagacagcgagtgacatcccatctcctcctctgcattaaagatgacctgctga

SEQ ID NO: 287357 - DNA, 1478 bp, Homo sapiens
gatcagctcctgagacatggagagaccagatcttcacacctgtaccagaccctacctcctcagacatggacaggctcagaaggaactggcaagaggggatcactactggtcaatggtgggggcagaaaacagatgggaaaaggctaagtagatgcgaggagaggaagtagagacagcagcatggaatacctgagaagggcaagcaaaggtcaggacaatttttaaaggtgagaatttagcaggttacaggttgcggagaaggaccgagggaaggaaaggttttggaaagtactggaggcaggaggcggtgggtggacactgagatgtctgggaaagggcttgcccctcagccatcactgaagtgtctctgaaagtgctgggatacctgggcatcgtgacccaggtgccatggactggagacctggggagacggacgagggctggcacagtcagggaatcctggaagaggtgcagagagagccaagggaggcaaggcctccagtccatcttccccacaggatccacctgatggctggccgagtaccccagggagctgatcgaatagcagtcaaggctgagatggaggccgtttttctggagaacctgaggcatgcagctggggttttggctcaggtgagaaaggtggaaacacacacgtacttacatgtctctgtgggtgtgcggagaagggggtgcacagtggggacagcacgtgaggctgccagcctaggtcagaggaacaggtgagggccttgaccagtgactgactgatgggggacaaacttgggaaggagctctattcacagcacccgacatgctgctaggaggacctcgtgggactgctggagcccatcaacacccgcatcactgacccccagtacttcctggacacgccccagcagggtacgaccccagccctgtctctccttctgtcccttttgattcctgtgctcttgaggctcacggtcccctccctggcttctcttacagcggcagccatcttacagaaggtaggaagacccaacctccaattacaaatggtaagtggaagggggtacttcgcagatcggaaggaggcggggcctgcggggtctcggagcggcagctatccttacagaaggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgtgagtatcagcctcgaggagacacagtagagggcttgagttggctacgttcatactgggataggcggggccacccagaggctggccagtgagggcccgcacaccacccacgtgcctccagacagcgagtgacatcccatctcctcctctgcattaaagatgacctgctga

SEQ ID NO: 287358 - DNA, 1131 bp, Homo sapiens
tttttttggcggtataaaagtgcttctttatttggtcatacagctttcaaatgttgcttaacgaacagatagcatttttataatcagaggaaagactcagtattaaagtgcgcgtcccatcattgcaaccgggccctcgggcagccagctctctcttgcttcgcgtccggctctcaggccctggagctcggcctccctaccttctccaggcgcgggtcctgctccttttccggccgccctcgctccgccccttcgcctctccccgtgatccctctctcgctaaccgtaggcgcttttcgtgaaggcccgggtttttacagcacttcgcttttctaaccacgaacagtgctcgttcgttcgcagggccagcaaggagagccccgcccccgcccgccgcccgccgcccgccgcccgccgcctttggatcccgcggactccgcccggcccggcctccccaggcatggcgccgctgcgcttctccgccaatctgtcctggctattccccgagctccccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgagacacagtagagggcttgagttggctacgttcatactgggataggcggggccacccagaggctggccagtgagggcccgcacaccacccacgtgcctccagacagcgagtgacatcccatctcctcctctgcattaaagatgacctgctga

SEQ ID NO: 287359 - DNA, 994 bp, Homo sapiens
gcgcggactcacccggccggctcccaggcatgcgcgctgcgcttctccgccaatctgtcctggctattccccgagctccccggcctccccgcgcgggtgcgggccgcgggcagctcgggcttcgaggccgtcgaggtggcctggccgtacgcggagacgcctgaggcgctggcgcgcgccgcgcgagaagcggggctgcggcttgtactgatcaacacgcccccgggagaccaagagaagggggaaatggggctgggggccgtccccgggagacaggcggccttccgagagggactggagcaggccgtgagtgggcattgcttgatgggcaggaagttgagtgttccttgcaagggtgctgtggcaagaggaggcctggtgtatttggcagcgttcctgaggctggacatgatccacctgatggctggccgagtaccccagggagctgatcgaatagcagtcaaggctgagatggaggccgtttttctggagaacctgaggcatgcagctggggttttggctcaggaggacctcgtgggactgctggagcccatcaacacccgcatcactgacccccagtacttcctggacacgccccagcaggcggcagccatcttacagaaggtaggaagacccaacctccaattacaaatggacatattccactggcagatcatggatgggaacctgacaggaaacatccgggagttcctgcccattgttgggcatgtgcaggtggcacaggtcccaggccgaggggagcccagcagccccggagagctgaatttcccctatctgtttcaactgctggaagatgaaggctacaaaggcttcgtgggctgagacacagtagagggcttgagttggctacgttcatactgggataggcggggccacccagaggctggccagtgagggcccgcacaccacccacgtgcctccagacagcgagtgacatcccatctcctcctctgcattaaagatgacctgctga

SEQ ID NO: 287360 - DNA, 2396 bp, Homo sapiens
atcactcaagatggctgcccccatcaagatgaccggggtgtgccggggggaaaggggcagcatgatggtctgagatggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcaccaatggggactttgccccgccggagcccccgccgagaggaacccctgcccaaccctgggagcttcgatgagctgcaccgtctatgcaaagacgcagcaggccaagttcctgacatggcagtttgatggcgagtatcggggagatgactacacagccactctgaccctaggaaatcctgacctgattggggagtcggtgatcatggttgctcacttcctgcagagcctcactcatcggctggtgctgggaggagagctagtttatcaccggcggccaggcgaagagggggccatcttgacactggctgggaagtactcggctgtacactgggtagctacattgaatgtgggatcaggcggggcccatgcaagttactaccacagggcaaatgaacaggttcaggttggagtggagtttgaggcaaacacaaggctacaagacacaacattctcctttggttaccacctgactctgccccaggccaacatggtatttagaggcttggtggatagtaactggtgtgtaggtgctgtgctggagaagaagatgccccctctgcctgtcaccctagcccttggagccttcctcaatcactggcgcaacagattccattgtggcttcagcatcactgtgggctgaggttgtccagagccagcccccacagcagctggaacctctgagtcaggtgccctagggccaaagactaggcccctcttcagagcccaccttgctgggtgatctctaggacccaggagcagagtggtggacaggaccatgccctcctcagaactggagctgccacaggggcagttgatgaggcagaggtttgaggatcccccctctgctaccagccccagtatcaccttccccatgctcttgtggctgtggactaagggagaaggattaaggggtatggctgaattcccccggcaccccttgccctcaggcttccttcttcctttccctttggttaatcctgcatgggattagctgaccatcctgttttccatcccagagcctcccaaggctgggaaagtagggctgaagggctagatgtttggtctcaggaagtggggcccacccattcccagaaggagcttctttacctcttagccctgaggtttcctccttcccatcttctgtgcttccagagaacaactttgttcctatggtcacccccactatccccatgaccgcatgaagaggcagttattgctttagtctttcattgcaaccactgggctccctttgaacccggcccaatctttggtcccagcattttcccactccagtgtatccagggtgttccaggtgagctggggaaggaagtgagcatggcctcagctgcagatctcctggagcagcggcatcatggcagacaggccctggatgtgctggatttggtacccgtaggcctcattaatgctccggagctcagccagcaggcctagcaacttcgcatacagaaacctttggaggaagtagtggggttgccaggaaaacaggagggaaataaggcagttgggagtcttgtctctaggccctgatcccctgaactattcctcagtgaagccaggtctgaacattagagaaaatcatgctctggtatgacagactatcagaggttccaaaggtcctccagggggcctcggtctgacactgtcttctctcaccatgctcagttttttctgaacccagagctctgagagccgagtgtgaagaaagctccagacttggccagaactccaaccatgtggaatctgagggcctggccttctagagcaggttctagaaggtggatgtgttctatggtataaagcatcccctttctggccaaactagctcttggaggaacgagcaaaacagaagcggtgcatacctcagagcctggataaatcacagactattgaacctggaactggctttgaccatgaaactgtgaatggccctaacttcaagggaaatgagaaatcgaaggaattggcccaatggcgaggagaggaaaggccaagggaagagaaaagtctgcgttagtctggagaagttggactagtgaggtaatggatgtcatcaatctcaggaatgctattacccagagcctctgagctactactttgcatctgtactgaataaaaaaaaaatctggaaaaagtgagatg

SEQ ID NO: 287361 - DNA, 2635 bp, Homo sapiens
gcctagggttgtctctccatgagtgctctccttccctactcttcctgttccaggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcaccaatggggactttgccccgccggagcccccgccgagaggaacccctgcccaaccctgggagcttcgatgagctgcaccgtctatgcaaagatgtattcccagcacagatggagggagtgaagctcgttgtcaacaaggttctgagcagccatttccaggtggcgcacactatacacatgagtgccctgggcttgccgggatatcacctccatgcggcctatgcaggggattggcagctcagtcccactgaggtgttccccactgtggtaggggatatggacagcagtggcagcctgaacgcccaggtcttgctcctcttggcagagcggctccgagctaaggctgtcttccagacgcagcaggccaagttcctgacatggcagtttgatggcgagtatcggggagatgactacacagccactctgaccctaggaaatcctgacctgattggggagtcggtgatcatggttgctcacttcctgcagagcctcactcatcggctggtgctgggaggagagctagtttatcaccggcggccaggcgaagagggggccatcttgacactggctgggaagtactcggctgtacactgggtagctacattgaatgtgggatcaggcggggcccatgcaagttactaccacagggcaaatgaacaggttcaggttggagtggagtttgaggcaaacacaaggctacaagacacaacattctcctttggttaccacctgactctgccccaggccaacatggtatttagaggcttggtggatagtaactggtgtgtaggtgctgtgctggagaagaagatgccccctctgcctgtcaccctagcccttggagccttcctcaatcactggcgcaacagattccattgtggcttcagcatcactgtgggctgaggttgtccagagccagcccccacagcagctggaacctctgagtcaggtgccctagggccaaagactaggcccctcttcagagcccaccttgctgggtgatctctaggacccaggagcagagtggtggacaggaccatgccctcctcagaactggagctgccacaggggcagttgatgaggcagaggtttgaggatcccccctctgctaccagccccagtatcaccttccccatgctcttgtggctgtggactaagggagaaggattaaggggtatggctgaattcccccggcaccccttgccctcaggcttccttcttcctttccctttggttaatcctgcatgggattagctgaccatcctgttttccatcccagagcctcccaaggctgggaaagtagggctgaagggctagatgtttggtctcaggaagtggggcccacccattcccagaaggagcttctttacctcttagccctgaggtttcctccttcccatcttctgtgcttccagagaacaactttgttcctatggtcacccccactatccccatgaccgcatgaagaggcagttattgctttagtctttcattgcaaccactgggctccctttgaacccggcccaatctttggtcccagcattttcccactccagtgtatccagggtgttccaggtgagctggggaaggaagtgagcatggcctcagctgcagatctcctggagcagcggcatcatggcagacaggccctggatgtgctggatttggtacccgtaggcctcattaatgctccggagctcagccagcaggcctagcaacttcgcatacagaaacctttggaggaagtagtggggttgccaggaaaacaggagggaaataaggcagttgggagtcttgtctctaggccctgatcccctgaactattcctcagtgaagccaggtctgaacattagagaaaatcatgctctggtatgacagactatcagaggttccaaaggtcctccagggggcctcggtctgacactgtcttctctcaccatgctcagttttttctgaacccagagctctgagagccgagtgtgaagaaagctccagacttggccagaactccaaccatgtggaatctgagggcctggccttctagagcaggttctagaaggtggatgtgttctatggtataaagcatcccctttctggccaaactagctcttggaggaacgagcaaaacagaagcggtgcatacctcagagcctggataaatcacagactattgaacctggaactggctttgaccatgaaactgtgaatggccctaacttcaagggaaatgagaaatcgaaggaattggcccaatggcgaggagaggaaaggccaagggaagagaaaagtctgcgttagtctggagaagttggactagtgaggtaatggatgtcatcaatctcaggaatgctattacccagagcctctgagctactactttgcatctgtactgaataaaaaaaaaatctggaaaaagtgagatg

SEQ ID NO: 287362 - DNA, 2557 bp, Homo sapiens
atcactcaagatggctgcccccatcaagatgaccggggtgtgccggggggaaaggggcagcatgatggtctgagatggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcaccaatggggactttgccccgccggagcccccgccgagaggaacccctgcccaaccctgggagcttcgatgagctgcaccgtctatgcaaagatgtattcccagcacagatggagggagtgaagctcgttgtcaacaaggttctgagcagccatttccaggtggcgcacactatacacatgagtgccctgggcttgccgggatatcacctccatgcggcctatgcaggggattggcagctcagtcccactgagacgcagcaggccaagttcctgacatggcagtttgatggcgagtatcggggagatgactacacagccactctgaccctaggaaatcctgacctgattggggagtcggtgatcatggttgctcacttcctgcagagcctcactcatcggctggtgctgggaggagagctagtttatcaccggcggccaggcgaagagggggccatcttgacactggctgggaagtactcggctgtacactgggtagctacattgaatgtgggatcaggcggggcccatgcaagttactaccacagggcaaatgaacaggttcaggttggagtggagtttgaggcaaacacaaggctacaagacacaacattctcctttggttaccacctgactctgccccaggccaacatggtatttagaggcttggtggatagtaactggtgtgtaggtgctgtgctggagaagaagatgccccctctgcctgtcaccctagcccttggagccttcctcaatcactggcgcaacagattccattgtggcttcagcatcactgtgggctgaggttgtccagagccagcccccacagcagctggaacctctgagtcaggtgccctagggccaaagactaggcccctcttcagagcccaccttgctgggtgatctctaggacccaggagcagagtggtggacaggaccatgccctcctcagaactggagctgccacaggggcagttgatgaggcagaggtttgaggatcccccctctgctaccagccccagtatcaccttccccatgctcttgtggctgtggactaagggagaaggattaaggggtatggctgaattcccccggcaccccttgccctcaggcttccttcttcctttccctttggttaatcctgcatgggattagctgaccatcctgttttccatcccagagcctcccaaggctgggaaagtagggctgaagggctagatgtttggtctcaggaagtggggcccacccattcccagaaggagcttctttacctcttagccctgaggtttcctccttcccatcttctgtgcttccagagaacaactttgttcctatggtcacccccactatccccatgaccgcatgaagaggcagttattgctttagtctttcattgcaaccactgggctccctttgaacccggcccaatctttggtcccagcattttcccactccagtgtatccagggtgttccaggtgagctggggaaggaagtgagcatggcctcagctgcagatctcctggagcagcggcatcatggcagacaggccctggatgtgctggatttggtacccgtaggcctcattaatgctccggagctcagccagcaggcctagcaacttcgcatacagaaacctttggaggaagtagtggggttgccaggaaaacaggagggaaataaggcagttgggagtcttgtctctaggccctgatcccctgaactattcctcagtgaagccaggtctgaacattagagaaaatcatgctctggtatgacagactatcagaggttccaaaggtcctccagggggcctcggtctgacactgtcttctctcaccatgctcagttttttctgaacccagagctctgagagccgagtgtgaagaaagctccagacttggccagaactccaaccatgtggaatctgagggcctggccttctagagcaggttctagaaggtggatgtgttctatggtataaagcatcccctttctggccaaactagctcttggaggaacgagcaaaacagaagcggtgcatacctcagagcctggataaatcacagactattgaacctggaactggctttgaccatgaaactgtgaatggccctaacttcaagggaaatgagaaatcgaaggaattggcccaatggcgaggagaggaaaggccaagggaagagaaaagtctgcgttagtctggagaagttggactagtgaggtaatggatgtcatcaatctcaggaatgctattacccagagcctctgagctactactttgcatctgtactgaataaaaaaaaaatctggaaaaagtgagatg

SEQ ID NO: 287363 - DNA, 2753 bp, Homo sapiens
atcactcaagatggctgcccccatcaagatgaccggggtgtgccggggggaaaggggcagcatgatggtctgagatggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcaccaatggggactttgccccgccggagcccccgccgagaggaacccctgcccaaccctgggagcttcgatgagctgcaccgtctatgcaaagatgtattcccagcacagatggagggagtgaagctcgttgtcaacaaggttctgagcagccatttccaggtggcgcacactatacacatgagtgccctgggcttgccgggatatcacctccatgcggcctatgcaggggattggcagctcagtcccactgaggtgttccccactgtggtaggggatatggacagcagtggcagcctgaacgcccaggtcttgctcctcttggcagagcggctccgagctaaggctgtcttccagacgcagcaggccaagttcctgacatggcagtttgatggcgagtatcggggagatgactacacagccactctgaccctaggaaatcctgacctgattggggagtcggtgatcatggttgctcacttcctgcagagcctcactcatcggctggtgctgggaggagagctagtttatcaccggcggccaggcgaagagggggccatcttgacactggctgggaagtactcggctgtacactgggtagctacattgaatgtgggatcaggcggggcccatgcaagttactaccacagggcaaatgaacaggttcaggttggagtggagtttgaggcaaacacaaggctacaagacacaacattctcctttggttaccacctgactctgccccaggccaacatggtatttagaggcttggtggatagtaactggtgtgtaggtgctgtgctggagaagaagatgccccctctgcctgtcaccctagcccttggagccttcctcaatcactggcgcaacagattccattgtggcttcagcatcactgtgggctgaggttgtccagagccagcccccacagcagctggaacctctgagtcaggtgccctagggccaaagactaggcccctcttcagagcccaccttgctgggtgatctctaggacccaggagcagagtggtggacaggaccatgccctcctcagaactggagctgccacaggggcagttgatgaggcagaggtttgaggatcccccctctgctaccagccccagtatcaccttccccatgctcttgtggctgtggactaagggagaaggattaaggggtatggctgaattcccccggcaccccttgccctcaggcttccttcttcctttccctttggttaatcctgcatgggattagctgaccatcctgttttccatcccagagcctcccaaggctgggaaagtagggctgaagggctagatgtttggtctcaggaagtggggcccacccattcccagaaggagcttctttacctcttagccctgaggtttcctccttcccatcttctgtgcttccagagaacaactttgttcctatggtcacccccactatccccatgaccgcatgaagaggcagttattgctttagtctttcattgcaaccactgggctccctttgaacccggcccaatctttggtcccagcattttcccactccagtgtatccagggtgttccaggtgagctggggaaggaagtgagcatggcctcagctgcagatctcctggagcagcggcatcatggcagacaggccctggatgtgctggatttggtacccgtaggcctcattaatgctccggagctcagccagcaggcctagcaacttcgcatacagaaacctttggaggaagtagtggggttgccaggaaaacaggagggaaataaggcagttgggagtcttgtctctaggccctgatcccctgaactattcctcagtgaagccaggtctgaacattagagaaaatcatgctctggtatgacagactatcagaggttccaaaggtcctccagggggcctcggtctgacactgtcttctctcaccatgctcagttttttctgaacccagagctctgagagccgagtgtgaagaaagctccagacttggccagaactccaaccatgtggaatctgagggcctggccttctagagcaggttctagaaggtggatgtgttctatggtataaagcatcccctttctggccaaactagctcttggaggaacgagcaaaacagaagcggtgcatacctcagagcctggataaatcacagactattgaacctggaactggctttgaccatgaaactgtgaatggccctaacttcaagggaaatgagaaatcgaaggaattggcccaatggcgaggagaggaaaggccaagggaagagaaaagtctgcgttagtctggagaagttggactagtgaggtaatggatgtcatcaatctcaggaatgctattacccagagcctctgagctactactttgcatctgtactgaataaaaaaaaaatctggaaaaagtgagatgaaacagcagtatccaaatacagcaatttggatgctgaaacgatgtgagacagggatggccagggggaaggactagaccccaagatacctgaatt

SEQ ID NO: 287364 - DNA, 2614 bp, Homo sapiens
atcactcaagatggctgcccccatcaagatgaccggggtgtgccggggggaaaggggcagcatgatggtctgagatggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcaccaatggggactttgccccgccggagcccccgccgagaggaacccctgcccaaccctgggagcttcgatgagctgcaccgtctatgcaaagatgtattcccagcacagatggagggagtgaagctcgttgtcaacaaggttctgagcagccatttccaggtggcgcacactatacacatgagtgccctgggcttgccgggatatcacctccatgcggcctatgcaggggattggcagctcagtcccactgaggtgttccccactgtggtaggggatatggacagcagtggcagcctgaacgcccaggtcttgctcctcttggcagagcggctccgagctaaggctgtcttccagacgcagcaggccaagttcctgacatggcagtttgatggcgagtatcggggagatgactacacagccactctgaccctaggaaatcctgacctgattggggagtcggtgatcatggttgctcacttcctgcagagcctcactcatcggctggtgctgggaggagagctagtttatcaccggcggccaggcgaagagggggccatcttgacactggctgggaagtactcggctgtacactgggtagctacattgaatgtgggatcaggcggggcccatgcaagttactaccacagggcaaatgaacaggttcaggttggagtggagtttgaggcaaacacaaggctacaagacacaacattctcctttggttaccacctgactctgccccaggccaacatggtatttagaggcttggtggatagtaactggtgtgtaggtgctgtgctggagaagaagatgccccctctgcctgtcaccctagcccttggagccttcctcaatcactggcgcaacagattccattgtggcttcagcatcactgtgggctgaggttgtccagagccagcccccacagcagctggaacctctgagtcaggtgccctagggccaaagactaggcccctcttcagagcccaccttgctgggtgatctctaggacccaggagcagagtggtggacaggaccatgccctcctcagaactggagctgccacaggggcagttgatgaggcagaggtttgaggatcccccctctgctaccagccccagtatcaccttccccatgctcttgtggctgtggactaagggagaaggattaaggggtatggctgaattcccccggcaccccttgccctcaggcttccttcttcctttccctttggttaatcctgcatgggattagctgaccatcctgttttccatcccagagcctcccaaggctgggaaagtagggctgaagggctagatgtttggtctcaggaagtggggcccacccattcccagaaggagcttctttacctcttagccctgaggtttcctccttcccatcttctgtgcttccagagaacaactttgttcctatggtcacccccactatccccatgaccgcatgaagaggcagttattgctttagtctttcattgcaaccactgggctccctttgaacccggcccaatctttggtcccagcattttcccactccagtgtatccagggtgttccaggtgagctggggaaggaagtgagcatggcctcagctgcagatctcctggagcagcggcatcatggcagacaggccctggatgtgctggatttggtacccgtaggcctcattaatgctccggagctcagccagcaggcctagcaacttcgcatacagaaacctttggaggaagtagtggggttgccaggaaaacaggagggaaataaggcagttgggagtcttgtctctaggccctgatcccctgaactattcctcagtgaagccaggtctgaacattagagaaaatcatgctctggtatgacagactatcagaggttccaaagtcagttttttctgaacccagagctctgagagccgagtgtgaagaaagctccagacttggccagaactccaaccatgtggaatctgagggcctggccttctagagcaggttctagaaggtggatgtgttctatggtataaagcatcccctttctggccaaactagctcttggaggaacgagcaaaacagaagcggtgcatacctcagagcctggataaatcacagactattgaacctggaactggctttgaccatgaaactgtgaatggccctaacttcaagggaaatgagaaatcgaaggaattggcccaatggcgaggagaggaaaggccaagggaagagaaaagtctgcgttagtctggagaagttggactagtgaggtaatggatgtcatcaatctcaggaatgctattacccagagcctctgagctactactttgcatctgtactgaataaaaaaaaaatctggaaaaagtgagatg

SEQ ID NO: 287365 - DNA, 2473 bp, Homo sapiens
atcactcaagatggctgcccccatcaagatgaccggggtgtgccggggggaaaggggcagcatgatggtctgagatggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcaccaatggggactttgccccgccggagcccccgccgagaggaacccctgcccaaccctgggagcttcgatgagctgcaccgtctatgcaaagatgtattcccagcacagatggagggagtgaagctcgttgtcaacaaggttctgagcagccatttccaggtggcgcacactatacacatgagtgccctgggcttgccgggatatcacctccatgcggcctatgcaggggattggcagctcagtcccactgaggtgttccccactgtggtaggggatatggacagcagtggcagcctgaacgcccaggtcttgctcctcttggcagagcggctccgagctaaggctgtcttccagacgcagcaggccaagttcctgacatggcagtttgatggcgagtatcggggagatgactacacagccactctgaccctaggaaatcctgacctgattggggagtcggtgatcatggttgctcacttcctgcagagcctcactcatcggctggtgctgggaggagagctagtttatcaccggcggccaggcgaagagggggccatcttgacactggctgggaagtactcggctgtacactgggtagctacattgaatgtgggatcaggcggggcccatgcaagttactaccacagggcaaatgaacaggttcaggttggagtggagtttgaggcaaacacaaggctacaagacacaacattctcctttggttaccacctgactctgccccaggccaacatggtatttagaggcttggtggatagtaactggtgtgtaggtgctgtgctggagaagaagatgccccctctgcctgtcaccctagcccttggagccttcctcaatcactggcgcaacagattccattgtggcttcagcatcactgtgggctgaggttgtccagagccagcccccacagcagctggaacctctgagtcaggtgccctagggccaaagactaggcccctcttcagagcccaccttgctgggtgatctctaggacccaggagcagagtggtggacaggaccatgccctcctcagaactggagctgccacaggggcagttgatgaggcagaggtttgaggatcccccctctgctaccagccccagtatcaccttccccatgctcttgtggctgtggactaagggagaaggattaaggggtatggctgaattcccccggcaccccttgccctcaggcttccttcttcctttccctttggttaatcctgcatgggattagctgaccatcctgttttccatcccagagcctcccaaggctgggaaagtagggctgaagggctagatgtttggtctcaggaagtggggcccacccattcccagaaggagcttctttacctcttagccctgaggtttcctccttcccatcttctgtgcttccagagaacaactttgttcctatggtcacccccactatccccatgaccgcatgaagaggcagttattgctttagtctttcattgcaaccactgggctccctttgaacccggcccaatctttggtcccagcattttcccactccagtgtatccagggtgttccaggtgagctggggaaggaagtgagcatggcctcagctgcagatctcctggagcagcggcatcatggcagacaggccctggatgtgctggatttggtacccgtaggcctcattaatgctccggagctcagccagcaggcctagcaacttcgcatacagaaacctttggaggaagtagtggggttgccaggaaaacaggagggaaataaggcagttgggagtcttgtctctaggccctgatcccctgaactattcctcagtgaagccaggtctgaacattagagaaaatcatgctctggtatgacagactatcagaggttccaaaggtcctccagggggcctcggtctgacactgtcttctctcaccatgcagaagcggtgcatacctcagagcctggataaatcacagactattgaacctggaactggctttgaccatgaaactgtgaatggccctaacttcaagggaaatgagaaatcgaaggaattggcccaatggcgaggagaggaaaggccaagggaagagaaaagtctgcgttagtctggagaagttggactagtgaggtaatggatgtcatcaatctcaggaatgctattacccagagcctctgagctactactttgcatctgtactgaataaaaaaaaaatctggaaaaagtgagatg

SEQ ID NO: 287366 - DNA, 904 bp, Homo sapiens
atcactcaagatggctgcccccatcaagatgaccggggtgtgccggggggaaaggggcagcatgatggtctgagatggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcaccaatggggactttgccccgccggagcccccgccgagaggaacccctgcccaaccctgggagcttcgatgagctgcaccgtctatgcaaagatgtattcccagcacagatggagggagtgaagctcgttgtcaacaaggttctgagcagccatttccaggtggcgcacactatacacatgagtgccctgggcttgccgggatatcacctccatgcggcctatgcaggggattggcagctcagtcccactgaggtgttccccactgtggtaggggatatggacagcagtggcagcctgaacgcccaggtcttgctcctcttggcagagcggctccgagctaaggctgtcttccagacgcagcaggccaagttcctgacatggcagtttgatggcgagtatcggggagatgactacacagccactctgaccctaggaaatcctgacctgattggggagtcggtgatcatggttgctcacttcctgcagagcctcactcatcggctggtgctgggaggagagctagtttatcaccggcggccaggcgaagagggggccatcttgacactggctgggaagtactcgggtatggggcgaagtgaagtagtggtggtggtggggggcaatacgaagacatgtcctattggacacggtctgagaacttgcaccgg

SEQ ID NO: 287367 - DNA, 2659 bp, Homo sapiens
atcactcaagatggctgcccccatcaagatgaccggggtgtgccggggggaaaggggcagcatgatggtctgagatggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcaccaatggggactttgccccgccggagcccccgccgagaggaacccctgcccaaccctgggagcttcgatgagctgcaccgtctatgcaaagatgtattcccagcacagatggagggagtgaagctcgttgtcaacaaggttctgagcagccatttccaggtggcgcacactatacacatgagtgccctgggcttgccgggatatcacctccatgcggcctatgcaggggattggcagctcagtcccactgaggtgttccccactgtggtaggggatatggacagcagtggcagcctgaacgcccaggtcttgctcctcttggcagagcggctccgagctaaggctgtcttccagacgcagcaggccaagttcctgacatggcagtttgatggcgagtatcggggagatgactacacagccactctgaccctaggaaatcctgacctgattggggagtcggtgatcatggttgctcacttcctgcagagcctcactcatcggctggtgctgggaggagagctagtttatcaccggcggccaggcgaagagggggccatcttgacactggctgggaagtactcggctgtacactgggtagctacattgaatgtgggatcaggcggggcccatgcaagttactaccacagggcaaatgaacaggttcaggttggagtggagtttgaggcaaacacaaggctacaagacacaacattctcctttggttaccacctgactctgccccaggccaacatggtatttagaggcttggtggatagtaactggtgtgtaggtgctgtgctggagaagaagatgccccctctgcctgtcaccctagcccttggagccttcctcaatcactggcgcaacagattccattgtggcttcagcatcactgtgggctgaggttgtccagagccagcccccacagcagctggaacctctgagtcaggtgccctagggccaaagactaggcccctcttcagagcccaccttgctgggtgatctctaggacccaggagcagagtggtggacaggaccatgccctcctcagaactggagctgccacaggggcagttgatgaggcagaggtttgaggatcccccctctgctaccagccccagtatcaccttccccatgctcttgtggctgtggactaagggagaaggattaaggggtatggctgaattcccccggcaccccttgccctcaggcttccttcttcctttccctttggttaatcctgcatgggattagctgaccatcctgttttccatcccagagcctcccaaggctgggaaagtagggctgaagggctagatgtttggtctcaggaagtggggcccacccattcccagaaggagcttctttacctcttagccctgaggtttcctccttcccatcttctgtgcttccagagaacaactttgttcctatggtcacccccactatccccatgaccgcatgaagaggcagttattgctttagtctttcattgcaaccactgggctccctttgaacccggcccaatctttggtcccagcattttcccactccagtgtatccagggtgttccaggtgagctggggaaggaagtgagcatggcctcagctgcagatctcctggagcagcggcatcatggcagacaggccctggatgtgctggatttggtacccgtaggcctcattaatgctccggagctcagccagcaggcctagcaacttcgcatacagaaacctttggaggaagtagtggggttgccaggaaaacaggagggaaataaggcagttgggagtcttgtctctaggccctgatcccctgaactattcctcagtgaagccaggtctgaacattagagaaaatcatgctctggtatgacagactatcagaggttccaaaggtcctccagggggcctcggtctgacactgtcttctctcaccatgctcagttttttctgaacccagagctctgagagccgagtgtgaagaaagctccagacttggccagaactccaaccatgtggaatctgagggcctggccttctagagcaggttctagaaggtggatgtgttctatggtataaagcatcccctttctggccaaactagctcttggaggaacgagcaaaacagaagcggtgcatacctcagagcctggataaatcacagactattgaacctggaactggctttgaccatgaaactgtgaatggccctaacttcaagggaaatgagaaatcgaaggaattggcccaatggcgaggagaggaaaggccaagggaagagaaaagtctgcgttagtctggagaagttggactagtgaggtaatggatgtcatcaatctcaggaatgctattacccagagcctctgagctactactttgcatctgtactgaataaaaaaaaaatctggaaaaagtgagatg

SEQ ID NO: 287368 - DNA, 2869 bp, Homo sapiens
atcactcaagatggctgcccccatcaagatgaccggggtgtgccggggggaaaggggcagcatgatggtctgagatggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcaccaatggggactttgccccgccggagcccccgccgagaggaacccctgcccaaccctgggagcttcgatgagctgcaccgtctatgcaaagatgtattcccagcacagatggagggagtgaagctcgttgtcaacaaggttctgagcagccatttccaggtggcgcacactatacacatgagtgccctgggcttgccgggatatcacctccatgcggcctatgcaggggattggcagctcagtcccactgaggtgttccccactgtggtaggggatatggacagcagtggcagcctgaacgcccaggtcttgctcctcttggcagagcggctccgagctaaggctgtcttccagacgcagcaggccaagttcctgacatggcagtttgatggcgagtatcggggagatgactacacagccactctgaccctaggaaatcctgacctgattggggagtcggtgatcatggttgctcacttcctgcagagcctcactcatcggctggtgctgggaggagagctagtttatcaccggcggccaggcgaagagggggccatcttgacactggctgggaagtactcggctgtacactgggtagctacattgaatgtgggatcaggcggggcccatgcaagttactaccacagggcaaatgaacaggtgagacctctgatctcattccctccttgtcagcaagtcagtcatgaacttctgttcatctggacctctatcgccctgctgacctatttttcttcctaccacgctgtgtatatatttacatgcatgcctccattctgctgattccccatcaggacccttctggtcttcactgatactgatctctctttcatccttgcccatggttctcaggttcaggttggagtggagtttgaggcaaacacaaggctacaagacacaacattctcctttggttaccacctgactctgccccaggccaacatggtatttagaggcttggtggatagtaactggtgtgtaggtgctgtgctggagaagaagatgccccctctgcctgtcaccctagcccttggagccttcctcaatcactggcgcaacagattccattgtggcttcagcatcactgtgggctgaggttgtccagagccagcccccacagcagctggaacctctgagtcaggtgccctagggccaaagactaggcccctcttcagagcccaccttgctgggtgatctctaggacccaggagcagagtggtggacaggaccatgccctcctcagaactggagctgccacaggggcagttgatgaggcagaggtttgaggatcccccctctgctaccagccccagtatcaccttccccatgctcttgtggctgtggactaagggagaaggattaaggggtatggctgaattcccccggcaccccttgccctcaggcttccttcttcctttccctttggttaatcctgcatgggattagctgaccatcctgttttccatcccagagcctcccaaggctgggaaagtagggctgaagggctagatgtttggtctcaggaagtggggcccacccattcccagaaggagcttctttacctcttagccctgaggtttcctccttcccatcttctgtgcttccagagaacaactttgttcctatggtcacccccactatccccatgaccgcatgaagaggcagttattgctttagtctttcattgcaaccactgggctccctttgaacccggcccaatctttggtcccagcattttcccactccagtgtatccagggtgttccaggtgagctggggaaggaagtgagcatggcctcagctgcagatctcctggagcagcggcatcatggcagacaggccctggatgtgctggatttggtacccgtaggcctcattaatgctccggagctcagccagcaggcctagcaacttcgcatacagaaacctttggaggaagtagtggggttgccaggaaaacaggagggaaataaggcagttgggagtcttgtctctaggccctgatcccctgaactattcctcagtgaagccaggtctgaacattagagaaaatcatgctctggtatgacagactatcagaggttccaaaggtcctccagggggcctcggtctgacactgtcttctctcaccatgctcagttttttctgaacccagagctctgagagccgagtgtgaagaaagctccagacttggccagaactccaaccatgtggaatctgagggcctggccttctagagcaggttctagaaggtggatgtgttctatggtataaagcatcccctttctggccaaactagctcttggaggaacgagcaaaacagaagcggtgcatacctcagagcctggataaatcacagactattgaacctggaactggctttgaccatgaaactgtgaatggccctaacttcaagggaaatgagaaatcgaaggaattggcccaatggcgaggagaggaaaggccaagggaagagaaaagtctgcgttagtctggagaagttggactagtgaggtaatggatgtcatcaatctcaggaatgctattacccagagcctctgagctactactttgcatctgtactgaataaaaaaaaaatctggaaaaagtgagatg

SEQ ID NO: 287369 - DNA, 2464 bp, Homo sapiens
atcactcaagatggctgcccccatcaagatgaccggggtgtgccggggggaaaggggcagcatgatggtctgagatggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcaccaatggggactttgccccgccggagcccccgccgagaggaacccctgcccaaccctgggagcttcgatgagctgcaccgtctatgcaaagatgtattcccagcacagatggagggagtgaagctcgttgtcaacaaggttctgagcagccatttccagacgcagcaggccaagttcctgacatggcagtttgatggcgagtatcggggagatgactacacagccactctgaccctaggaaatcctgacctgattggggagtcggtgatcatggttgctcacttcctgcagagcctcactcatcggctggtgctgggaggagagctagtttatcaccggcggccaggcgaagagggggccatcttgacactggctgggaagtactcggctgtacactgggtagctacattgaatgtgggatcaggcggggcccatgcaagttactaccacagggcaaatgaacaggttcaggttggagtggagtttgaggcaaacacaaggctacaagacacaacattctcctttggttaccacctgactctgccccaggccaacatggtatttagaggcttggtggatagtaactggtgtgtaggtgctgtgctggagaagaagatgccccctctgcctgtcaccctagcccttggagccttcctcaatcactggcgcaacagattccattgtggcttcagcatcactgtgggctgaggttgtccagagccagcccccacagcagctggaacctctgagtcaggtgccctagggccaaagactaggcccctcttcagagcccaccttgctgggtgatctctaggacccaggagcagagtggtggacaggaccatgccctcctcagaactggagctgccacaggggcagttgatgaggcagaggtttgaggatcccccctctgctaccagccccagtatcaccttccccatgctcttgtggctgtggactaagggagaaggattaaggggtatggctgaattcccccggcaccccttgccctcaggcttccttcttcctttccctttggttaatcctgcatgggattagctgaccatcctgttttccatcccagagcctcccaaggctgggaaagtagggctgaagggctagatgtttggtctcaggaagtggggcccacccattcccagaaggagcttctttacctcttagccctgaggtttcctccttcccatcttctgtgcttccagagaacaactttgttcctatggtcacccccactatccccatgaccgcatgaagaggcagttattgctttagtctttcattgcaaccactgggctccctttgaacccggcccaatctttggtcccagcattttcccactccagtgtatccagggtgttccaggtgagctggggaaggaagtgagcatggcctcagctgcagatctcctggagcagcggcatcatggcagacaggccctggatgtgctggatttggtacccgtaggcctcattaatgctccggagctcagccagcaggcctagcaacttcgcatacagaaacctttggaggaagtagtggggttgccaggaaaacaggagggaaataaggcagttgggagtcttgtctctaggccctgatcccctgaactattcctcagtgaagccaggtctgaacattagagaaaatcatgctctggtatgacagactatcagaggttccaaaggtcctccagggggcctcggtctgacactgtcttctctcaccatgctcagttttttctgaacccagagctctgagagccgagtgtgaagaaagctccagacttggccagaactccaaccatgtggaatctgagggcctggccttctagagcaggttctagaaggtggatgtgttctatggtataaagcatcccctttctggccaaactagctcttggaggaacgagcaaaacagaagcggtgcatacctcagagcctggataaatcacagactattgaacctggaactggctttgaccatgaaactgtgaatggccctaacttcaagggaaatgagaaatcgaaggaattggcccaatggcgaggagaggaaaggccaagggaagagaaaagtctgcgttagtctggagaagttggactagtgaggtaatggatgtcatcaatctcaggaatgctattacccagagcctctgagctactactttgcatctgtactgaataaaaaaaaaatctggaaaaagtgagatg

SEQ ID NO: 287370 - DNA, 2007 bp, Homo sapiens
atcactcaagatggctgcccccatcaagatgaccggggtgtgccggggggaaaggggcagcatgatggtctgagatggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcaccaatggggactttgccccgccggagcccccgccgagaggaacccctgcccaaccctgggagcttcgatgagctgcaccgtctatgcaaagatgtattcccagcacagatggagggagtgaagctcgttgtcaacaaggttctgagcagccatttccaggtggcgcacactatacacatgagtgccctgggcttgccgggatatcacctccatgcggcctatgcaggggattggcagctcagtcccactgaggtgttccccactgtggtaggggatatggacagcagtggcagcctgaacgcccaggtcttgctcctcttggcagagcggctccgagctaaggctgtcttccagacgcagcaggccaagttcctgacatggcagtttgatggcgagtatcggggagatgactacacagccactctgaccctaggaaatcctgacctgattggggagtcggtgatcatggttgctcacttcctgcagagcctcactcatcggctggtgctgggaggagagctagtttatcaccggcggccaggcgaagagggggccatcttgacactggctgggaagtactcggctgtacactgggtagctacattgaatgtgggatcaggcggggcccatgcaagttactaccacagggcaaatgaacaggttcaggttggagtggagtttgaggcaaacacaaggctacaagacacaacattctcctttggttaccacctgactctgccccaggccaacatggtatttagaggcttggtggatagtaactggtgtgtaggtgctgtgctggagaagaagatgccccctctgcctgtcaccctagcccttggagccttcctcaatcactggcgcaacagattccattgtggcttcagcatcactgtgggctgaggttgtccagagccagcccccacagcagctggaacctctgagtcaggtgccctagggccaaagactaggcccctcttcagagcccaccttgctgggtgatctctaggacccaggagcagagtggtggacaggaccatgccctcctcagaactggagctgccacaggggcagttgatgaggcagaggtttgaggatcccccctctgctaccagccccagtatcaccttccccatgctcttgtggctgtggactaagggagaaggattaaggggtatggctgaattcccccggcaccccttgccctcaggcttccttcttcctttccctttggttaatcctgcatgggattagctgaccatcctgttttccatcccagagcctcccaaggctgggaaagtagggctgaagggctagatgtttggtctcaggaagtggggcccacccattcccagaaggagcttctttacctcttagccctgaggtttcctccttcccatcttctgtgcttccagagaacaactttgttcctatggtcacccccactatccccatgaccgcatgaagaggcagttattgctttagtctttcattgcaaccactgggctccctttgaacccggcccaatctttggtcccagcattttcccactccagtgtatccagggtgttccaggtgagcgatcccggggccttcgctgctggcccttgatgtagctttgcagagtcagtgccatctcctcttgcagctgatcaatctcatctctctgggtaactccaggtcggtcacgggctccatcttcaattgtgtagcgaagaggcccgcagaggaagttttgtgtttggagacagaaagtggtattgagtacgat

SEQ ID NO: 287371 - DNA, 517 bp, Homo sapiens
ctggagaacacagcagcatgcctgggaactgaactacaattcccagagtgcatctctaggaggattctgggaagtgtggcagaagcagcaatggtccctccagggaacggaagccgttgaacgtgaacatttggagtttcctcttttgtgctgattcctgaggactaggaaggtgccccgaaaagaattcagagacctgacaatgtccctgtattgtggaatagcttgcaggagaaaatttttttggtgctataggctgctgtcaacctatgttactaagacacgatttctacatggttgtcaatcatgcctatgtaatgaagccaccataaaaacccaaaaggacagggttcagagagcctctggatagctgaacacatggaagttcctggagggtggtgcacccagggagtcatggaagctctgcaccctccccccacatacctgacctaaatgcatctcttcatttgtatccttcgtaatatcctatataataaaccagtaaacatcaaaaaat

SEQ ID NO: 287372 - DNA, 837 bp, Homo sapiens
tgaaggagggaaaattattttttagaaagcaaactataaagcaggtcagtgagaccttcaaagctgtattcccgtggttcctcagttttccatatttccctgtcccatggaggtccacagtcgtggagaaacggactctaaacacaggcgaagtatcactcggtcgcccaggctggagtttcctcttttgtgctgattcctgaggactaggaaggtgccccgaaaagaattcagagtgagtacagtgaaacagaaacctgctcagcttctaagtgcaggaaggacttcacagggaggcatgatcagaacttgaaaaaaggtcgtggtcacagcattttaacattttagcttaatctcttcctttttgcagaaaccagggatataaccatagttttgcctcataactgtggagctacatcagtaaccacagctcatcattttctgatacttttttggagagtcatttaaaaatggaacttgccaacctctcacattgtgccttaatttttatttttttttaaaggagggaaaattattttttagaaagcaaactataaagcaggtcagtgagaccttcaaagctgtattcccgtggttcctcagttttccatatttccctgtcccatggaggtccacagtcgtggagaaacggactctaaacacaggcgaagtatcacttggtcgcccaggctggagtgcagtgacacgatctccactcactgcaagctccgcctcctgggttcatgccattctcctgcctcatactccctagtagctgggactacaggcgcccgccaccacgcccagccacttttttttgtatttttaacagagacg

SEQ ID NO: 287373 - DNA, 402 bp, Homo sapiens
gatgcagcgacagcattctcaaagatgaatgctatacaggtaactaagggtggttttgtaatggtttgattatttcccaaatacaggtatttatttgaactgaaggaagatgatgatgcatgtaaaaaagcccagcaaacaggagcgttttacctctttcatagtctggctcctctgcttcagacttcagcacatcaatacctggccccccggcacagcctgttaggtaagtccagagtggaccagtggcgttgaccagcctgtggccactacgcagaattcagcccataatgaattctaagaaagatccttgaactttggagtctagatttttcagaaagcttttgagtctctggcgtgaatcgccgcccagtgaatccgttatcatggtgaaccttttcc

SEQ ID NO: 287374 - DNA, 2188 bp, Homo sapiens
ctggagaacacagcagcatgcctgggaactgaactacaattcccagagtgcatctctaggaggattctgggaagtgtggcagaagcagcaatggtccctccagggaacggaagccgttgaacgtgaacatttggagtttcctcttttgtgctgattcctgaggactaggaaggtgccccgaaaagaattcagagacctgacaatgtccctgtattgtggaatagcttgcaggagaaaatttttttggtgctataggctgctgtcaacctatgttactaagacacggtatttatttgaactgaaggaagatgatgatgcatgtaaaaaagcccagcaaacaggagcgttttacctctttcatagtctggctcctctgcttcagacttcagcacatcaatacctggccccccggcacagcctgttagagttggaaaggctcctgggtaaatttggacaggatgcacaaagaatagaagattctgtgctgattggatgctctgagcagcaggaagcatggtttgctctggatctaggtctggatagctccttttccataagtgcctccttacacaaacctgaaatggagacagagctcaaggggtctttcattgagctgagaaaggcactctttcaactcaatgcaagggatgcctccttgctgtccacggctcaagctcttctccgctggcatgatgctcatcagttctgcagcagaagtgggcagcccaccaagaagaacgtggctggcagcaagcgtgtgtgcccttccaataatataatctattatccacagatggctcctgtggcgatcacgctggtgtcagatgggacccgatgcctgcttgcccgccaaagctcctttcccaagggaatgtattctgccttggcaggtttttgtgatataggtgaaagtgtggaagagaccatccgccgagaagttgcagaagaggtgggattggaggtggaaagcctgcagtactatgcatcccagcattggcccttccctagtggctcactcatgattgcttgccatgcaactgtgaaaccagggcagacagaaatccaggtgaacttgagagaattagagacagctgcctggttcagtcatgatgaggtagccacagccctgaagagaaagggcccctatactcagcaacagaatgggactttcccattctggctgccccctaagttagccatctcccaccaactgattaaggagtgggtggaaaaacagacctgttcttccctgcctgcttagcccggatcaagtcacttagatcgctccttggtattcctgagggacaaactagagatcagttgacaaaggagaagtgacaaaagataagctgcagaaggacctcagaagggcagagcaaagggtgagcctacagttaagacacttctatcagcagtgttaatggaagaaattcctaccaatgggcaatcaaaaaagccagtgtgagaagaaaactgatgagctgtcaactgtcaaaaatcagggggaagggggaagcattagtttggatgtaggcccttgttcagtcattttctctaaggccttggaagcaaacatcttctggcatatggcttgttaatgttgtgtttacactaactgccaaaatgtgcctgttgtaagtttggttaaaacttttatcttagtattgaaaatatatagcaagttttaagtcattactgagttacttgttacccttacagaattaagaaaaatagcacagtatgacattttaaaattcatgtacaggtgcattctagttacatgaacatgctagttaaataaaagtcacaattaagtcattatgactcagagtactttataataaatcagatgccctgaggctctgttgaggaagtagaatcccaatgggactccagacagtaaatctttttcgctgttttcagctctgtcacatgctcagtttgtgacccagggaaaagactattgctttgccatgcctgttttcctaaataaaacagttgctggcatttgcacatccacaacgtgttgattaacaaagggattggtggagataaacagatgccaaacctgacctatttcttaaactttatggaataaactaaatttaggatttctcatcattcatatatgatgccataagggagaagagtttatttggggaaaataaaagaaatttccacacctttg

SEQ ID NO: 287375 - DNA, 2081 bp, Homo sapiens
tcaatgacttaataagttaactatcatgcatcttactaactaggggatattttcctttcatgatacagtcatagagtaatacaatgttatacaagaattccttctttggtctaaagtcctcagactgctaatgagaaaacaggcctggagaggttaaatggttagaccaaggttacatagctaattagctgcagttggaagccaagtatacccactttaagctgaagtagatgattttctgtgagtctaatatggctgtagtgatttaatagaaacccttgtgttttgcttttctcccttcccctttctgtttcttagagttggaaaggctcctgggtaaatttggacaggatgcacaaagaatagaagattctgtgctgattggatgctctgagcagcaggaagcatggtttgctctggatctaggtctggatagctccttttccataagtgcctccttacacaaacctgaaatggagacagagctcaaggggtctttcattgagctgagaaaggcactctttcaactcaatgcaagggatgcctccttgctgtccacggctcaagctcttctccgctggcatgatgctcatcagttctgcagcagaagtgggcagcccaccaagaagaacgtggctggcagcaagcgtgtgtgcccttccaataatataatctattatccacagatggctcctgtggcgatcacgctggtgtcagatgggacccgatgcctgcttgcccgccaaagctcctttcccaagggaatgtattctgccttggcaggtttttgtgatataggtgaaagtgtggaagagaccatccgccgagaagttgcagaagaggtgggattggaggtggaaagcctgcagtactatgcatcccagcattggcccttccctagtggctcactcatgattgcttgccatgcaactgtgaaaccagggcagacagaaatccaggtgaacttgagagaattagagacagctgcctggttcagtcatgatgaggtagccacagccctgaagagaaagggcccctatactcagcaacagaatgggactttcccattctggctgccccctaagttagccatctcccaccaactgattaaggagtgggtggaaaaacagacctgttcttccctgcctgcttagcccggatcaagtcacttagatcgctccttggtattcctgagggacaaactagagatcagttgacaaaggagaagtgacaaaagataagctgcagaaggacctcagaagggcagagcaaagggtgagcctacagttaagacacttctatcagcagtgttaatggaagaaattcctaccaatgggcaatcaaaaaagccagtgtgagaagaaaactgatgagctgtcaactgtcaaaaatcagggggaagggggaagcattagtttggatgtaggcccttgttcagtcattttctctaaggccttggaagcaaacatcttctggcatatggcttgttaatgttgtgtttacactaactgccaaaatgtgcctgttgtaagtttggttaaaacttttatcttagtattgaaaatatatagcaagttttaagtcattactgagttacttgttacccttacagaattaagaaaaatagcacagtatgacattttaaaattcatgtacaggtgcattctagttacatgaacatgctagttaaataaaagtcacaattaagtcattatgactcagagtactttataataaatcagatgccctgaggctctgttgaggaagtagaatcccaatgggactccagacagtaaatctttttcgctgttttcagctctgtcacatgctcagtttgtgacccagggaaaagactattgctttgccatgcctgttttcctaaataaaacagttgctggcatttgcacatccacaacgtgttgattaacaaagggattggtggagataaacagatgccaaacctgacctatttcttaaactttatggaataaactaaatttaggatttctcatcattcatatatgatgccataagggagaagagtttatttggggaaaataaaagaaatttccacacctttg

SEQ ID NO: 287376 - DNA, 2076 bp, Homo sapiens
ctggagaacacagcagcatgcctgggaactgaactacaattcccagagtgcatctctaggaggattctgggaagtgtggcagaagcagcaatggtccctccagggaacggaagccgttgaacgtgaacatttggagtttcctcttttgtgctgattcctgaggactaggaaggtgccccgaaaagaattcagagacctgacaatgtccctgtattgtggaatagcttgcaggagaaaatttttttggtgctataggctgctgtcaacctatgttactaagacacggtatttatttgaactgaaggaagatgatgatgcatgtaaaaaagcccagcaaacaggagcgttttacctctttcatagtctggctcctctgcttcagacttcagcacatcaatacctggccccccggcacagcctgttagagttggaaaggctcctgggtaaatttggacaggatgcacaaagaatagaagattctgtgctgattggatgctctgagcagcaggaagcatggtttgctctggatctaggtctggatagctccttttccataagtgcctccttacacaaacctgaaatggagacagagctcaaggggtctttcattgagctgagaaaggcactctttcaactcaatgcaagggatgcctccttgctgtccacggctcaagctcttctccgctggcatgatgctcatcagttctgcagcagaagtgggcagcccaccaagaagaacgtggctggcagcaagcgtgtgtgcccttccaataatataatctattatccacaggtgaaagtgtggaagagaccatccgccgagaagttgcagaagaggtgggattggaggtggaaagcctgcagtactatgcatcccagcattggcccttccctagtggctcactcatgattgcttgccatgcaactgtgaaaccagggcagacagaaatccaggtgaacttgagagaattagagacagctgcctggttcagtcatgatgaggtagccacagccctgaagagaaagggcccctatactcagcaacagaatgggactttcccattctggctgccccctaagttagccatctcccaccaactgattaaggagtgggtggaaaaacagacctgttcttccctgcctgcttagcccggatcaagtcacttagatcgctccttggtattcctgagggacaaactagagatcagttgacaaaggagaagtgacaaaagataagctgcagaaggacctcagaagggcagagcaaagggtgagcctacagttaagacacttctatcagcagtgttaatggaagaaattcctaccaatgggcaatcaaaaaagccagtgtgagaagaaaactgatgagctgtcaactgtcaaaaatcagggggaagggggaagcattagtttggatgtaggcccttgttcagtcattttctctaaggccttggaagcaaacatcttctggcatatggcttgttaatgttgtgtttacactaactgccaaaatgtgcctgttgtaagtttggttaaaacttttatcttagtattgaaaatatatagcaagttttaagtcattactgagttacttgttacccttacagaattaagaaaaatagcacagtatgacattttaaaattcatgtacaggtgcattctagttacatgaacatgctagttaaataaaagtcacaattaagtcattatgactcagagtactttataataaatcagatgccctgaggctctgttgaggaagtagaatcccaatgggactccagacagtaaatctttttcgctgttttcagctctgtcacatgctcagtttgtgacccagggaaaagactattgctttgccatgcctgttttcctaaataaaacagttgctggcatttgcacatccacaacgtgttgattaacaaagggattggtggagataaacagatgccaaacctgacctatttcttaaactttatggaataaactaaatttaggatttctcatcattcatatatgatgccataagggagaagagtttatttggggaaaataaaagaaatttccacacctttg

SEQ ID NO: 287377 - DNA, 1404 bp, Homo sapiens
ctggagaacacagcagcatgcctgggaactgaactacaattcccagagtgcatctctaggaggattctgggaagtgtggcagaagcagcaatggtccctccagggaacggaagccgttgaacgtgaacatttggagtttcctcttttgtgctgattcctgaggactaggaaggtgccccgaaaagaattcagagacctgacaatgtccctgtattgtggaatagcttgcaggagaaaatttttttggtgctataggctgctgtcaacctatgttactaagacacggtatttatttgaactgaaggaagatgatgatgcatgtaaaaaagcccagcaaacaggagcgttttacctctttcatagtctggctcctctgcttcagacttcagcacatcaatacctggccccccggcacagcctgttagagttggaaaggctcctgggtaaatttggacaggatgcacaaagaatagaagattctgtgctgattggatgctctgagcagcaggaagcatggtttgctctggatctaggtctggatagctccttttccataagtgcctccttacacaaacctgaaatggagacagagctcaaggggtctttcattgagctgagaaaggcactctttcaactcaatgcaagggatgcctccttgctgtccacggctcaagctcttctccgctggcatgatgctcatcagttctgcagcagaagtgggcagcccaccaagaagaacgtggctggcagcaagcgtgtgtgcccttccaataatataatctattatccacagatggctcctgtggcgatcacgctggtgtcagatgggacccgatgcctgcttgcccgccaaagctcctttcccaagggaatgtattctgccttggcaggtttttgtgatataggtgaaagtgtggaagagaccatccgccgagaagttgcagaagaggtgggattggaggtggaaagcctgcagtactatgcatcccagcattggcccttccctagtggctcactcatgattgcttgccatgcaactgtgaaaccagggcagacagaagtaagttctcatcttcccttatactgtgatatttcttttgcttcatccaacctgctcatcagcaagtacttattaagcacttgtctagtccagcatcatctagattacataaacatgtgtaaaatatgatttagggctgagcacggtggctcatgcctgtaatcccaacactttgggaggctgatgtgggcggatcacttgaggtcaggagttcaagaccagcctggccaacatggcaaaactccatctctactaaaaatacaaaaattaaggccgggtgcgatggctcatgcctgtaatcccagctttttttttttttttttttttttaaaaggggggttggg

SEQ ID NO: 287378 - DNA, 233 bp, Homo sapiens
gacctgacaatgtccctgtattgtggaatagcttgcaggagaaaatttttttggtgctataggctgctgtcaacctatgttactaagacacggtgagttttagccaacctgagctttgattattctgtttggcccattaaactattgtgatattatgattttatatatatatttaggtttatgattattatatatacattatatattactatatttgtgtgtgtgtatatgtg

SEQ ID NO: 287379 - DNA, 1793 bp, Homo sapiens
ccgtccgcctccggccaacacgaaccgctcggaggactaggaaggtgccccgaaaagaattcagagacctgacaatgtccctgtattgtggaatagcttgcaggagaaaatttttttggtgctataggctgctgtcaacctatgttactaagacacggtatttatttgaactgaaggaagatgatgatgcatgtaaaaaagcccagcaaacaggagcgttttacctctttcatagtctggctcctctgcttcagacttcagcacatcaatacctggccccccggcacagcctgttagagttggaaaggctcctgggtaaatttggacaggatgcacaaagaatagaagattctgtgctgattggatgctctgagcagcaggaagcatggtttgctctggatctaggtctggatagctccttttccataagtgcctccttacacaaacctgaaatggagacagagctcaaggggtctttcattgagctgagaaaggcactctttcaactcaatgcaagggatgcctccttgctgtccacggctcaagctcttctccgctggcatgatgctcatcagttctgcagcagaagtgggcagcccaccaagaagaacgtggctggcagcaagcgtgtgtgcccttccaataatataatctattatccacagatccaggtgaacttgagagaattagagacagctgcctggttcagtcatgatgaggtagccacagccctgaagagaaagggcccctatactcagcaacagaatgggactttcccattctggctgccccctaagttagccatctcccaccaactgattaaggagtgggtggaaaaacagacctgttcttccctgcctgcttagcccggatcaagtcacttagatcgctccttggtattcctgagggacaaactagagatcagttgacaaaggagaagtgacaaaagataagctgcagaaggacctcagaagggcagagcaaagggtgagcctacagttaagacacttctatcagcagtgttaatggaagaaattcctaccaatgggcaatcaaaaaagccagtgtgagaagaaaactgatgagctgtcaactgtcaaaaatcagggggaagggggaagcattagtttggatgtaggcccttgttcagtcattttctctaaggccttggaagcaaacatcttctggcatatggcttgttaatgttgtgtttacactaactgccaaaatgtgcctgttgtaagtttggttaaaacttttatcttagtattgaaaatatatagcaagttttaagtcattactgagttacttgttacccttacagaattaagaaaaatagcacagtatgacattttaaaattcatgtacaggtgcattctagttacatgaacatgctagttaaataaaagtcacaattaagtcattatgactcagagtactttataataaatcagatgccctgaggctctgttgaggaagtagaatcccaatgggactccagacagtaaatctttttcgctgttttcagctctgtcacatgctcagtttgtgacccagggaaaagactattgctttgccatgcctgttttcctaaataaaacagttgctggcatttgcacatccacaacgtgttgattaacaaagggattggtggagataaacagatgccaaacctgacctatttcttaaactttatggaataaactaaatttaggatttctcatcattcatatatgatgccataagggagaagagtttatttggggaaaataaaagaaatttccacacctttg

SEQ ID NO: 287380 - DNA, 1368 bp, Homo sapiens
ccgggaaggagagctctctgggggggtctttaggcccaggggtggctcactgcgttccctccccaagcctgccgcaccaacccgtgcctccatgggggtcgctgcctagaggtggagggccaccgcctgtgccactgcccggtgggctacaccggacccttctgcgacgtgggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgc

SEQ ID NO: 287381 - DNA, 1263 bp, Homo sapiens
ggtgacccctccgccccagggctccgggctcccggcgctctaacggcgccccgtcgtgtggctacaggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgc

SEQ ID NO: 287382 - DNA, 2391 bp, Homo sapiens
ctattgatctggactcctggataggcagctggaccaacggacggacgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggacccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggaggttaggaagtgggggggggaaggaggagccgagagggcgccgggcgagctagattccggccagccggccgcgggctctccgtcctcagcccctgctcctccacagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcgagtacccgcccgcccagagccgccccaggggccgcggctcctccgtctcccagcgcagcttccacgctgcacccgaacccgtgccctaccttctcccgccccacccttctttccacgcccctccggagctcccggggaggaagctggaacacgggattggggttcgggagcagggggcttccccagaacgcttgtggccaggtctgagagcgctgcctctcccctaccctccccgcaggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgc

SEQ ID NO: 287383 - DNA, 3029 bp, Homo sapiens
ctattgatctggactcctggataggcagctggaccaacggacggacgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggacccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggaggttaggaagtgggggggggaaggaggagccgagagggcgccgggcgagctagattccggccagccggccgcgggctctccgtcctcagcccctgctcctccacagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcgagtacccgcccgcccagagccgccccaggggccgcggctcctccgtctcccagcgcagcttccacgctgcacccgaacccgtgccctaccttctcccgccccacccttctttccacgcccctccggagctcccggggaggaagctggaacacgggattggggttcgggagcagggggcttccccagaacgcttgtggccaggtctgagagcgctgcctctcccctaccctccccgcaggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctgggtgcgtgggggcgccccgcggggacgggaagagagcttggggccccggcgtccccgcctcacgctcctctccgcccgggttagctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggtaggcacaactgctaggggcaggggtaggggaggagacctttgatcactgggttaggcggaagaagcccgcgactttggtatcgttccgggtgcctacagaatgggtggcgctgacctgatgggttgtgagaatgtgtaggtgaatcccaggtagaatcccagggcctgggattcactgctgggatccccaaatctcctggggatacagggagaatcgaacttgctcttggttccctctgggcgccgggctgcaaaggccaactaggacgctggccccgcgctccgggctagtgtgggagccaggttctgcgactctggatgggtggtgggggaggggtttctgtttccgctccgcccattcaaatcctggcttttctctggacctcagcctccttgcctatgaaattgaattaatggcacctcctccccttcgggcttgctgcgagagaggaagggcatgagtgggtttacaagcgcctggagcagctttgtccatcgtccgggcggcaagcgttgtcagatggggtgtgaagaaggcgctctgtgttcgcaggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgc

SEQ ID NO: 287384 - DNA, 1504 bp, Homo sapiens
ggtgacccctccgccccagggctccgggctcccggcgctctaacggcgccccgtcgtgtggctacaggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcgagtacccgcccgcccagagccgccccaggggccgcggctcctccgtctcccagcgcagcttccacgctgcacccgaacccgtgccctaccttctcccgccccacccttctttccacgcccctccggagctcccggggaggaagctggaacacgggattggggttcgggagcagggggcttccccagaacgcttgtggccaggtctgagagcgctgcctctcccctaccctccccgcaggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgc

SEQ ID NO: 287385 - DNA, 3359 bp, Homo sapiens
ctattgatctggactcctggataggcagctggaccaacggacggacgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggacccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggaggttaggaagtgggggggggaaggaggagccgagagggcgccgggcgagctagattccggccagccggccgcgggctctccgtcctcagcccctgctcctccacagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcgagtacccgcccgcccagagccgccccaggggccgcggctcctccgtctcccagcgcagcttccacgctgcacccgaacccgtgccctaccttctcccgccccacccttctttccacgcccctccggagctcccggggaggaagctggaacacgggattggggttcgggagcagggggcttccccagaacgcttgtggccaggtctgagagcgctgcctctcccctaccctccccgcaggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctgggtgcgtgggggcgccccgcggggacgggaagagagcttggggccccggcgtccccgcctcacgctcctctccgcccgggttagctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggtaggcacaactgctaggggcaggggtaggggaggagacctttgatcactgggttaggcggaagaagcccgcgactttggtatcgttccgggtgcctacagaatgggtggcgctgacctgatgggttgtgagaatgtgtaggtgaatcccaggtagaatcccagggcctgggattcactgctgggatccccaaatctcctggggatacagggagaatcgaacttgctcttggttccctctgggcgccgggctgcaaaggccaactaggacgctggccccgcgctccgggctagtgtgggagccaggttctgcgactctggatgggtggtgggggaggggtttctgtttccgctccgcccattcaaatcctggcttttctctggacctcagcctccttgcctatgaaattgaattaatggcacctcctccccttcgggcttgctgcgagagaggaagggcatgagtgggtttacaagcgcctggagcagctttgtccatcgtccgggcggcaagcgttgtcagatggggtgtgaagaaggcgctctgtgttcgcaggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccaggtgagctcttagcccggttggcgcccttccccgaggccgtcaggcacaaatctcaggtccacagcgctgagctgcgtgtttccgacccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgctgagaaaaaaagctcttttcttcatgggtcccgccgggaaatgccaagacagaaaagcgattcacagcttctccacagctctcagagaacaaggtctatgagatcttaacgtgcaaaatctagatgccagcccagctaatgtttactgagcctaggatactgtataccaagccctgtgcaaggagaagctgcatgttattccttatgagaaactaacattttgtttacagagcagtagtt

SEQ ID NO: 287386 - DNA, 2451 bp, Homo sapiens
ctattgatctggactcctggataggcagctggaccaacggacggacgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggacccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcgagtacccgcccgcccagagccgccccaggggccgcggctcctccgtctcccagcgcagcttccacgctgcacccgaacccgtgccctaccttctcccgccccacccttctttccacgcccctccggagctcccggggaggaagctggaacacgggattggggttcgggagcagggggcttccccagaacgcttgtggccaggtctgagagcgctgcctctcccctaccctccccgcaggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgaggcctccttgcctatgaaattgaattaatggcacctcctccccttcgggcttgctgcgagagaggaagggcatgagtgggtttacaagcgcctggagcagctttgtccatcgtccgggcggcaagcgttgtcagatggggtgtgaagaaggcgctctgtgttcgcaggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgc

SEQ ID NO: 287387 - DNA, 2070 bp, Homo sapiens
ctattgatctggactcctggataggcagctggaccaacggacggacgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggacccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtccgctccccacatccccacgatatgggtgtgtgtccccagtggggttggtgtgcatgtgtacaaaggaaaaaaaaactttt

SEQ ID NO: 287388 - DNA, 1561 bp, Homo sapiens
ccctaacttgtggcttaaagcaacaacatttaatgatgatttatcacagtttctgatggtcagttttgccttgaggtctttcataagattgcaagccaaatgtcagcgagggctgcagtatccacttccaaggcagcttattcatgtggctgtccaattggcactggctgtcagcagggtgctttcctttctccctacatgggcttctctgcagggctgcatgtgtgtcctcacaacacagtggctggcttcctccagagtgagcaaccgcttgcacgaggccttctcgcccgtcagctaccagcacgacctgggtgcgtgggggcgccccgcggggacgggaagagagcttggggccccggcgtccccgcctcacgctcctctccgcccgggttagctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggtaggcacaactgctaggggcaggggtaggggaggagacctttgatcactgggttaggcggaagaagcccgcgactttggtatcgttccgggtgcctacagaatgggtggcgctgacctgatgggttgtgagaatgtgtaggtgaatcccaggtagaatcccagggcctgggattcactgctgggatccccaaatctcctggggatacagggagaatcgaacttgctcttggttccctctgggcgccgggctgcaaaggccaactaggacgctggccccgcgctccgggctagtgtgggagccaggttctgcgactctggatgggtggtgggggaggggtttctgtttccgctccgcccattcaaatcctggcttttctctggacctcagcctccttgcctatgaaattgaattaatggcacctcctccccttcgggcttgctgcgagagaggaagggcatgagtgggtttacaagcgcctggagcagctttgtccatcgtccgggcggcaagcgttgtcagatggggtgtgaagaaggcgctctgtgttcgcaggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgc

SEQ ID NO: 287389 - DNA, 2045 bp, Homo sapiens
ctattgatctggactcctggataggcagctggaccaacggacggacgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggacccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgc

SEQ ID NO: 287390 - DNA, 2285 bp, Homo sapiens
ctattgatctggactcctggataggcagctggaccaacggacggacgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggacccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgctgagaaaaaaagctcttttcttcatgggtcccgccgggaaatgccaagacagaaaagcgattcacagcttctccacagctctcagagaacaaggtctatgagatcttaacgtgcaaaatctagatgccagcccagctaatgtttactgagcctaggatactgtataccaagccctgtgcaaggagaagctgcatgttattccttatgagaaactaacattttgtttacagagcagtagtt

SEQ ID NO: 287391 - DNA, 2286 bp, Homo sapiens
ctattgatctggactcctggataggcagctggaccaacggacggacgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggacccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcgagtacccgcccgcccagagccgccccaggggccgcggctcctccgtctcccagcgcagcttccacgctgcacccgaacccgtgccctaccttctcccgccccacccttctttccacgcccctccggagctcccggggaggaagctggaacacgggattggggttcgggagcagggggcttccccagaacgcttgtggccaggtctgagagcgctgcctctcccctaccctccccgcaggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgc

SEQ ID NO: 287392 - DNA, 2714 bp, Homo sapiens
ctattgatctggactcctggataggcagctggaccaacggacggacgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggacccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggaggttaggaagtgggggggggaaggaggagccgagagggcgccgggcgagctagattccggccagccggccgcgggctctccgtcctcagcccctgctcctccacagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcgagtacccgcccgcccagagccgccccaggggccgcggctcctccgtctcccagcgcagcttccacgctgcacccgaacccgtgccctaccttctcccgccccacccttctttccacgcccctccggagctcccggggaggaagctggaacacgggattggggttcgggagcagggggcttccccagaacgcttgtggccaggtctgagagcgctgcctctcccctaccctccccgcaggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctgggtgcgtgggggcgccccgcggggacgggaagagagcttggggccccggcgtccccgcctcacgctcctctccgcccgggttagctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgctgagaaaaaaagctcttttcttcatgggtcccgccgggaaatgccaagacagaaaagcgattcacagcttctccacagctctcagagaacaaggtctatgagatcttaacgtgcaaaatctagatgccagcccagctaatgtttactgagcctaggatactgtataccaagccctgtgcaaggagaagctgcatgttattccttatgagaaactaacattttgtttacagagcagtagtt

SEQ ID NO: 287393 - DNA, 3269 bp, Homo sapiens
ctattgatctggactcctggataggcagctggaccaacggacggacgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggacccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggaggttaggaagtgggggggggaaggaggagccgagagggcgccgggcgagctagattccggccagccggccgcgggctctccgtcctcagcccctgctcctccacagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcgagtacccgcccgcccagagccgccccaggggccgcggctcctccgtctcccagcgcagcttccacgctgcacccgaacccgtgccctaccttctcccgccccacccttctttccacgcccctccggagctcccggggaggaagctggaacacgggattggggttcgggagcagggggcttccccagaacgcttgtggccaggtctgagagcgctgcctctcccctaccctccccgcaggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctgggtgcgtgggggcgccccgcggggacgggaagagagcttggggccccggcgtccccgcctcacgctcctctccgcccgggttagctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggtaggcacaactgctaggggcaggggtaggggaggagacctttgatcactgggttaggcggaagaagcccgcgactttggtatcgttccgggtgcctacagaatgggtggcgctgacctgatgggttgtgagaatgtgtaggtgaatcccaggtagaatcccagggcctgggattcactgctgggatccccaaatctcctggggatacagggagaatcgaacttgctcttggttccctctgggcgccgggctgcaaaggccaactaggacgctggccccgcgctccgggctagtgtgggagccaggttctgcgactctggatgggtggtgggggaggggtttctgtttccgctccgcccattcaaatcctggcttttctctggacctcagcctccttgcctatgaaattgaattaatggcacctcctccccttcgggcttgctgcgagagaggaagggcatgagtgggtttacaagcgcctggagcagctttgtccatcgtccgggcggcaagcgttgtcagatggggtgtgaagaaggcgctctgtgttcgcaggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgctgagaaaaaaagctcttttcttcatgggtcccgccgggaaatgccaagacagaaaagcgattcacagcttctccacagctctcagagaacaaggtctatgagatcttaacgtgcaaaatctagatgccagcccagctaatgtttactgagcctaggatactgtataccaagccctgtgcaaggagaagctgcatgttattccttatgagaaactaacattttgtttacagagcagtagtt

SEQ ID NO: 287394 - DNA, 1609 bp, Homo sapiens
ggtgacccctccgccccagggctccgggctcccggcgctctaacggcgccccgtcgtgtggctacaggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggaggttaggaagtgggggggggaaggaggagccgagagggcgccgggcgagctagattccggccagccggccgcgggctctccgtcctcagcccctgctcctccacagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcgagtacccgcccgcccagagccgccccaggggccgcggctcctccgtctcccagcgcagcttccacgctgcacccgaacccgtgccctaccttctcccgccccacccttctttccacgcccctccggagctcccggggaggaagctggaacacgggattggggttcgggagcagggggcttccccagaacgcttgtggccaggtctgagagcgctgcctctcccctaccctccccgcaggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgc

SEQ ID NO: 287395 - DNA, 2933 bp, Homo sapiens
ctattgatctggactcctggataggcagctggaccaacggacggacgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggacccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggaggttaggaagtgggggggggaaggaggagccgagagggcgccgggcgagctagattccggccagccggccgcgggctctccgtcctcagcccctgctcctccacagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcgagtacccgcccgcccagagccgccccaggggccgcggctcctccgtctcccagcgcagcttccacgctgcacccgaacccgtgccctaccttctcccgccccacccttctttccacgcccctccggagctcccggggaggaagctggaacacgggattggggttcgggagcagggggcttccccagaacgcttgtggccaggtctgagagcgctgcctctcccctaccctccccgcaggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctgggtgcgtgggggcgccccgcggggacgggaagagagcttggggccccggcgtccccgcctcacgctcctctccgcccgggttagctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggtaggcacaactgctaggggcaggggtaggggaggagacctttgatcactgggttaggcggaagaagcccgcgactttggtatcgttccgggtgcctacagaatgggtggcgctgacctgatgggttgtgagaatgtgtaggtgaatcccaggtagaatcccagggcctgggattcactgctgggatccccaaatctcctggggatacagggagaatcgaacttgctcttggttccctctgggcgccgggctgcaaaggccaactaggacgctggccccgcgctccgggctagtgtgggagccaggttctgcgactctggatgggtggtgggggaggggtttctgtttccgctccgcccattcaaatcctggcttttctctggacctcagcctccttgcctatgaaattgaattaatggcacctcctccccttcgggcttgctgcgagagaggaagggcatgagtgggtttacaagcgcctggagcagctttgtccatcgtccgggcggcaagcgttgtcagatggggtgtgaagaaggcgctctgtgttcgcaggggcggaggaatatgccagcttcctgcaggaggcgcaggtaccgttcctctccctggagcgctgctcagccccggacgtgcacggatcctccatcctccccggcatgctcctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgc

SEQ ID NO: 287396 - DNA, 1352 bp, Homo sapiens
agggaactggagcatctgccgccatttcttgcttttgcctttgcgatttccaccgccaccgcttgcacgaggccttctcgcccgtcagctaccagcacgacctgggtgcgtgggggcgccccgcggggacgggaagagagcttggggccccggcgtccccgcctcacgctcctctccgcccgggttagctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggtaggcacaactgctaggggcaggggtaggggaggagacctttgatcactgggttaggcggaagaagcccgcgactttggtatcgttccgggtgcctacagaatgggtggcgctgacctgatgggttgtgagaatgtgtaggtgaatcccaggtagaatcccagggcctgggattcactgctgggatccccaaatctcctggggatacagggagaatcgaacttgctcttggttccctctgggcgccgggctgcaaaggccaactaggacgctggccccgcgctccgggctagtgtgggagccaggttctgcgactctggatgggtggtgggggaggggtttctgtttccgctccgcccattcaaatcctggcttttctctggacctcagcctccttgcctatgaaattgaattaatggcacctcctccccttcgggcttgctgcgagagaggaagggcatgagtgggtttacaagcgcctggagcagctttgtccatcgtccgggcggcaagcgttgtcagatggggtgtgaagaaggcgctctgtgttcgcaggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgc

SEQ ID NO: 287397 - DNA, 529 bp, Homo sapiens
ttccagtccagggatcaccggtggagacccattagtctatgccatcctagtcccacccgcctgacacctcatgctcaccagaaggacaccttgggctgaccagagaggagggtttctgtgtgagaagcgatttgtgaatgcatctcataaatgccctgctctcagctgctgaacattctcctgctgaaaggcagggagctaattagcacagccacctcgacagcgtctgttccagtcacccctgcatgcatgctagaacacctttgaacaatggatgacagtctgcagagagcacagagctcccggagaacataaaaatgcaatggaacagaatgaagggatgcaagtcacaatcgtctcaactgcaagttggccaaagtaaacattgccccaaagtgctcccaaagcttgctggcacataaacatgaatgaatgaacaatgtagaattcactcaagaaatttcaaggagagagaggaggagatttacatcacacagcaaacaacctaataaatctgttaaacgccatg

SEQ ID NO: 287398 - DNA, 484 bp, Homo sapiens
ccgagaagagtaatgtcttgctctccgccctgacaacttttatgtattataatttgaccgcgctgggccacgctgcgcagtcgcagctcggaaccgctgcgttaacccagccccggaaataacgtaccgatcttcggagtccaagtcggaagttgactagagagtcacctgctttcgtccgctctaggacaccagacacaccaggccgccatgttgtgtaaggatccccagccagtgagcctaaaatgggtagaaggaaaagatatttcttaccctacgcacccaggtccaagtcatcattattttgtctgaaatttatcttcctaactgatttctctgcttccccattgtgccttaagagttagttttccacagagcagctcgagatatcttttcagatcattatatccctttgcttaaaaacctctaacagcttcctattaggcttagaataaagtacaaactccttaatgtgaaattgagt

SEQ ID NO: 287399 - DNA, 1894 bp, Homo sapiens
ggccctgtagcggaagcccaggtcaaggccctaacaaaagggcccgcctatggccacagtttcaggccctcctttcagtcatggactgttgaagcacgatttcctggtgctttcgcccctttcaccgaccatttcaagagtccgtagttctcgcctgggtttggattcggtataagtgagcctgtttaccatcaaagaaaatggtgaaatgtcttctggagacgatgttctcttctggttctaaccctgtcactcagtgagacccccagagaagcctagttttcagattattctagtccttggcaggctcaagatgtcaacaacacggttggaaacaacccctgagaggtcacatagcgcgcactcagctttacagatcgtccaaggcagcgacccctgagaggtcacatagcgcgcactcagctttatagatcgtccaaggcagcaattagaatcagcaactcggagaggaaaaaaagctgttagcggaatggaggctgaccattatctgtagtaaagaatcggaagtacagtacaaaaataaattaccgaaacgcaacatgcgtgaatttcacacaaaaaaatgaagttgagggaaagaagccagacatggaagagttcatattgcgtggttccatttaaaaactagcccatggtgttaatgagcatagtggggaggacaatgacatgaaagagccaccagggggcttttgaggttcaggtaatgtttcttgatttggacactgattatagataggtgggttcactttagaaatctcattgagttgtaaacgtatatttatgtacgtagttttttctgtagattatgcttaaggcccggcgaaggggaatttgcccaggtaatggaaatattacaccgatacatagaattgtcaaagttcatgggatgaactcctaagagctgtgtattttatcgtataaatttttttaagtgtccaaccaatagcctggaattattaagtacataattaaataaaaacaaatatcccatggacctaatgcagtgaacagttacctcgttctcttaattgctcaggctaaggactcatacctgagtcttctatctcaggccttacatcttatataacaagccttactggcttaatcttcaaaatatgtagcgaatttaacgagttctcacaacctctgcttctaccacctgacggggtttgggacatgctacccaaaaatatggcacctagacatattgaatactttgaactgaaggaatttgagaaagaacatatgcaggaatgtctctaactttcttgcacctttctgctctgaagcaggacgtaataccctcatgtgagaattgccctgtctatacctggaataaaagtaacatctttatctctgaaaacacagggacgtagagacgaatatgaacatcaggccttgctaagtttcccccagtttattacccttagatcacagtcttttagccccatcacattttcccacaattctccattcttcttcaaacctactctaaacaacactaaggttaactatttattcgggtcttcatttctttatgaagtttccatgttatgtaaaactaacattaatatttatgcttttctcttgttaatttgtcttttgttacaggatccccagccagtgagcctaaaatgggtagaaggaaaagatatttcttaccctacgcacccaggtccaagtcatcattattttgtctgaaatttatcttcctaactgatttctctgcttccccattgtgccttaagagttagttttccacagagcagctcgagatatcttttcagatcattatatccctttgcttaaaaacctctaacagcttcctattaggcttagaataaagtacaaactccttaatgtgaaattgagt

SEQ ID NO: 287400 - DNA, 1448 bp, Homo sapiens
  misc_feature (32)..(32): n is a, c, g, or t
cacagtggacagggagacctcacagagaaagncctggaaggtgatttcccgtgtgactcatggataggacccaaaatgtgttccatgcccaaaaataaattaccgaaacgcaacatgcgtgaatttcacacaaaaaaatgaagttgagggaaagaagccagacatggaagagttcatattgcgtggttccatttaaaaactagcccatggtgttaatgagcatagtggggaggacaatgacatgaaagagccaccagggggcttttgaggttcaggtaatgtttcttgatttggacactgattatagataggtgggttcactttagaaatctcattgagttgtaaacgtatatttatgtacgtagttttttctgtagattatgcttaaggcccggcgaaggggaatttgcccaggtaatggaaatattacaccgatacatagaattgtcaaagttcatgggatgaactcctaagagctgtgtattttatcgtataaatttttttaagtgtccaaccaatagcctggaattattaagtacataattaaataaaaacaaatatcccatggacctaatgcagtgaacagttacctcgttctcttaattgctcaggctaaggactcatacctgagtcttctatctcaggccttacatcttatataacaagccttactggcttaatcttcaaaatatgtagcgaatttaacgagttctcacaacctctgcttctaccacctgacggggtttgggacatgctacccaaaaatatggcacctagacatattgaatactttgaactgaaggaatttgagaaagaacatatgcaggaatgtctctaactttcttgcacctttctgctctgaagcaggacgtaataccctcatgtgagaattgccctgtctatacctggaataaaagtaacatctttatctctgaaaacacagggacgtagagacgaatatgaacatcaggccttgctaagtttcccccagtttattacccttagatcacagtcttttagccccatcacattttcccacaattctccattcttcttcaaacctactctaaacaacactaaggttaactatttattcgggtcttcatttctttatgaagtttccatgttatgtaaaactaacattaatatttatgcttttctcttgttaatttgtcttttgttacaggatccccagccagtgagcctaaaatgggtagaaggaaaagatatttcttaccctacgcacccaggtccaagtcatcattattttgtctgaaatttatcttcctaactgatttctctgcttccccattgtgccttaagagttagttttccacagagcagctcgagatatcttttcagatcattatatccctttgcttaaaaacctctaacagcttcctattaggcttagaataaagtacaaactccttaatgtgaaattgagt

SEQ ID NO: 287401 - DNA, 843 bp, Homo sapiens
gatcagtctaggaggtccagtatctaaataggagtcatagaaaaagaaaaatggcaacacagagggaaggaaataattgaggaactaattcaagaacatttattggaacttgaggacattagttttcatattgaaaggacccatcgaatattcagcacaatggatgaaagtgacccacccaaagcacagtcatcctgagatttcagaacactggaaacagagatcctatgagttttcagagagaggaaaaaaaagtcacatacaaaaagtcagaattgccttggactctcaacaacaccagcagctagcaggcaatggagcaatgccttcaacattctgcaggaaaacacattccaagctttcctgcagattctctattcagccgaattataaatccaaggatgagggtagaataaagatatctacaggctgcaaggtctcaaaaacacatacctcccatgcaccctttctcaggaagctactggaagatgtgttccaccaaaataagggagtaatcaaaaaagataaaaacgcgatataggagcaccagtagaggacagacgtgaaaggggtacccaggatggtgatgaagaaagatcccaggatgacagcagtgcacaccagacaaaccagcccagatttgagcaggtcagaaggctccagggagatttctttgggtagtttaaattttgatagactgtctaatgcttttgaacctcttaaaaggagatttaaatagttggtgaagcatttgggggttggattagttataagaattatacatagaaaattaaacaaaaggacaagacattaactccaggtaaaacaaagttgtgaaggaaa

SEQ ID NO: 287402 - DNA, 2857 bp, Homo sapiens
gcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgtttgtattttgggttggtttacactcgcacatactcagttttcagttttcccctttttaaaaaataaatcgctgacaagtgtgaatcccgtgaagactttattttgtgttgtgtgtatcctgtacagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaatacaagcggctccgtcccatgaccctcgccgtcagccggatccgtgcggtccgcgaggacccgggggagggcggttaccgaggcccgccaccgccggaagggtgggttccttgccttccgccccagtctggcgactgccatgacgtgggcggaagtggcgtcgccgcagcggggatgtggggcggggcctgccccaagagagtttcctaaagcgaggaaaccaagccgggcgcctcttgcaatggagacggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacga

SEQ ID NO: 287403 - DNA, 1715 bp, Homo sapiens
gcgcccttaaagatggtgagggggctcatgctctgagtagaaggtggtgacctccaggagcggtgggatgatgagggcccgggcgcctcttgcaatggagacggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacga

SEQ ID NO: 287404 - DNA, 3238 bp, Homo sapiens
gcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgtttgtattttgggttggtttacactcgcacatactcagttttcagttttcccctttacagtcttctcccctcacctccaggaccctccccctttttaaaaaataaatcgctgacaagtgtgaatcccgtgaagactttattttgtgttgtgtgtatcctgtacagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaatacaagcggctccgtcccatgaccctcgccgtcagccggatccgtgcggtccgcgaggacccgggggagggcggttaccgaggcccgccaccgccggaagggtgggttccttgccttccgccccagtctggcgactgccatgacgtgggcggaagtggcgtcgccgcagcggggatgtggggcggggcctgccccaagagagtttcctaaagcgaggaaaccaagccgggcgcctcttgcaatggagacggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacgaaaaaaaaaaaaaaaaaaaaaaaaaaaaactttttgggacacaagaacaccacaggaaaaactataaaacaaaacataaagagagacggaaaccccaaagaggaagcacaaagagcccaaagaggtaccccaaaagagaacacgagaaacaggaaaaaggggaaggacatctcacacaacaataaaaaaaccgcacgaggcggagacacgcacgaggacggtagagaacaaaaacacagaaagggacacagaggagcgacaacaacgggagaccaaaacacacgagagatacgcacaaagagaggcgagaattaaaaataccccacaagagagagaggagaagg

SEQ ID NO: 287405 - DNA, 1928 bp, Homo sapiens
ttttagaggtttgagagcgcagggttgtgagccggctttgctgggtgaggcacggggcgtccagagggatctccgcttgcaggggacccatggaagatttatgagcaagtcagtgaatgtcctttaggaatgttcatagcagctttctgtacatggactgagctacttcgaaaagtaaagtttcttgttaatggggatgaaagtcccttccaaatctgagatgctttggtgaacaaacttggtgaaagcatgaaagataaattgaagaacagatagatttgggccaaggaccccagtttaaacaacgttggagacggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacga

SEQ ID NO: 287406 - DNA, 3069 bp, Homo sapiens
gcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgtttgtattttgggttggtttacactcgcacatactcagttttcagttttcccctttacagtcttctcccctcacctccaggaccctccccctttttaaaaaataaatcgctgacaagtgtgaatcccgtgaagactttattttgtgttgtgtgtatcctgtacagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaatacaagcggctccgtcccatgaccctcgccgtcagccggatccgtgcggtccgcgaggacccgggggagggcggttaccgaggcccgccaccgccggaagggtgggttccttgccttccgccccagtctggcgactgccatgacgtgggcggaagtggcgtcgccgcagcggggatgtggggcggggcctgccccaagagagtttcctaaagcgaggaaaccaagccgggcgcctcttgcaatggagacggtcatttcttcagatagctccccagctgtggaaaatgagcatcctcaaggaagctactggaagatgtgttccaccaaaataagggagtaatcaaaaaagataaaaacgcgatataggagcaccagtagaggacagacgtgaaaggggtacccaggatggtgatgaagaaagatcccaggatgacagcagtgcacaccagacaaaccagcccagatttgagcagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacga

SEQ ID NO: 287407 - DNA, 1638 bp, Homo sapiens
tgagagaccgtgttgcaatggagacggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacga

SEQ ID NO: 287408 - DNA, 2944 bp, Homo sapiens
gcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgtttgtattttgggttggtttacactcgcacatactcagttttcagttttcccctttacagtcttctcccctcacctccaggaccctccccctttttaaaaaataaatcgctgacaagtgtgaatcccgtgaagactttattttgtgttgtgtgtatcctgtacagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaatacaagcggctccgtcccatgaccctcgccgtcagccggatccgtgcggtccgcgaggacccgggggagggcggttaccgaggcccgccaccgccggaagggtgggttccttgccttccgccccagtctggcgactgccatgacgtgggcggaagtggcgtcgccgcagcggggatgtggggcggggcctgccccaagagagtttcctaaagcgaggaaaccaagccgggcgcctcttgcaatggagacggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcagtcctgcccctgtggatttgcctttatgattattactgtcttggctacaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacga

SEQ ID NO: 287409 - DNA, 2785 bp, Homo sapiens
gcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgtttgtattttgggttggtttacactcgcacatactcagttttcagttttcccctttacagtcttctcccctcacctccaggaccctccccctttttaaaaaataaatcgctgacaagtgtgaatcccgtgaagactttattttgtgttgtgtgtatcctgtacagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaatacaagcggctccgtcccatgaccctcgccgtcagccggatccgtgcggtccgcgaggacccgggggagggcggttaccgaggcccgccaccgccggaagggtgggttccttgccttccgccccagtctggcgactgccatgacgtgggcggaagtggcgtcgccgcagcggggatgtggggcggggcctgccccaagagagtttcctaaagcgaggaaaccaagccgggcgcctcttgcaatggagacggtcatttcttcagatagctccccagctgtggaaaatgagcatcctcaaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacga

SEQ ID NO: 287410 - DNA, 3094 bp, Homo sapiens
gcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgtttgtattttgggttggtttacactcgcacatactcagttttcagttttcccctttacagtcttctcccctcacctccaggaccctccccctttttaaaaaataaatcgctgacaagtgtgaatcccgtgaagactttattttgtgttgtgtgtatcctgtacagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaatacaagcggctccgtcccatgaccctcgccgtcagccggatccgtgcggtccgcgaggacccgggggagggcggttaccgaggcccgccaccgccggaagggtgggttccttgccttccgccccagtctggcgactgccatgacgtgggcggaagtggcgtcgccgcagcggggatgtggggcggggcctgccccaagagagtttcctaaagcgaggaaaccaagccgggcgcctcttgcaatggagacggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgggtgaaatcctcttttcccttccccctttggagcctgtggtttaatacctctcatcctatctcatcctaagggtaatatccttatccttctgtgaagttagtctcatgttttacccaacatgcccaaacactgttctttttttacagtcctgcccctgtggatttgcctttatgattattactgtcttggctacaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacga

SEQ ID NO: 287411 - DNA, 2841 bp, Homo sapiens
gcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgtttgtattttgggttggtttacactcgcacatactcagttttcagttttcccctttacagtcttctcccctcacctccaggaccctccccctttttaaaaaataaatcgctgacaagtgtgaatcccgtgaagactttattttgtgttgtgtgtatcctgtacagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaatacaagcggctccgtcccatgaccctcgccgtcagccggatccgtgcggtccgcgaggacccgggggagggcggttaccgaggcccgccaccgccggaagggtgggttccttgccttccgccccagtctggcgactgccatgacgtgggcggaagtggcgtcgccgcagcggggatgtggggcggggcctgccccaagagagtttcctaaagcgaggaaaccaagccgggcgcctcttgcaatggagacggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaatctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacga

SEQ ID NO: 287412 - DNA, 2211 bp, Homo sapiens
gatcagtctaggaggtccagtatctaaataggagtcatagaaaaagaaaaatggcaacacagagggaaggaaataattgaggaactaattcaagaacatttattggaacttgaggacattagttttcatattgaaaggacccatcgaatattcagcacaatggatgaaagtgacccacccaaagcacagtcatcctgagatttcagaacactggaaacagagatcctatgagttttcagagagaggaaaaaaaagtcacatacaaaaagtcagaattgccttggactctcaacaacaccagcagctagcaggcaatggagcaatgccttcaacattctgcaggaaaacacattccaagctttcctgcagattctctattcagccgaattataaatccaaggatgagggtagaataaagatatctacaggctgcaaggtctcaaaaacacatacctcccatgcaccctttctcaggaagctactggaagatgtgttccaccaaaataagggagtaatcaaaaaagataaaaacgcgatataggagcaccagtagaggacagacgtgaaaggggtacccaggatggtgatgaagaaagatcccaggatgacagcagtgcacaccagacaaaccagcccagatttgagcagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacga

SEQ ID NO: 287413 - DNA, 2882 bp, Homo sapiens
gcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgtttgtattttgggttggtttacactcgcacatactcagttttcagttttcccctttacagtcttctcccctcacctccaggaccctccccctttttaaaaaataaatcgctgacaagtgtgaatcccgtgaagactttattttgtgttgtgtgtatcctgtacagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaatacaagcggctccgtcccatgaccctcgccgtcagccggatccgtgcggtccgcgaggacccgggggagggcggttaccgaggcccgccaccgccggaagggtgggttccttgccttccgccccagtctggcgactgccatgacgtgggcggaagtggcgtcgccgcagcggggatgtggggcggggcctgccccaagagagtttcctaaagcgaggaaaccaagccgggcgcctcttgcaatggagacggtcatttcttcagatagctccccagctgtggaaaatgagcatcctcaaggtgaagaaagctttttttgctttggtgactaacggtgtacgagctgcccctttatgggatagtaagaagcaaagttttgtgggtaagcaaaagtttctggaacacaatattattggcatcttgtgctgggcagggagacaagcttcaggcagtgctgagggctctgtcttgtcctctaggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacga

SEQ ID NO: 287414 - DNA, 1631 bp, Homo sapiens
ttgatatcgaattcgcggccgcgtcgacacggctgcgacgacagaagggggggcgcctcttgcaatggagacggtcatttcttcagatagctccccagctgtggtcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacga

SEQ ID NO: 287415 - DNA, 1439 bp, Homo sapiens
cttggtgatctagaggatccctgctgctagactattttatgggatagtaagaagcaaacgttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacga

SEQ ID NO: 287416 - DNA, 947 bp, Homo sapiens
tcctccgttgtcagtggtggatgagaaggggcaaatggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacga

SEQ ID NO: 287417 - DNA, 1035 bp, Homo sapiens
gcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgtttgtattttgggttggtttacactcgcacatactcagttttcagttttcccctttacagtcttctcccctcacctccaggaccctccccctttttaaaaaataaatcgctgacaagtgtgaatcccgtgaagactttattttgtgttgtgtgtatcctgtacagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaata

SEQ ID NO: 287418 - DNA, 1615 bp, Homo sapiens
gcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgtttgtattttgggttggtttacactcgcacatactcagttttcagttttcccctttacagtcttctcccctcacctccaggaccctccccctttttaaaaaataaatcgctgacaagtgtgaatcccgtgaagactttattttgtgttgtgtgtatcctgtacagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaatacaagcggctccgtcccatgaccctcgccgtcagccggatccgtgcggtccgcgaggacccgggggagggcggttaccgaggcccgccaccgccggaagggtgggttccttgccttccgccccagtctggcgactgccatgacgtgggcggaagtggcgtcgccgcagcggggatgtggggcggggcctgccccaagagagtttcctaaagcgaggaaaccaagccgggcgcctcttgcaatggagacggtcatttcttcagatagctccccagctgtggaaaatgagcatcctcaaggtaagtttactgaagaaaggaaactgggcatgaaaacaatagcctgaccctaacaatgtcttcaacaatgcttttgaatctctcccctggaaaaatcaaagcagggccagataatgtgccaaaccacaaaaatcagtgacagtagtttggcaagatcacccaggaataaatcttgggcagagtggggatgattaatatcttcaattatcaaaccacttgagagaaacatctgaggtacaggcaaaacttccataggcaactctgggctggctaccatgtttta

SEQ ID NO: 287419 - DNA, 963 bp, Homo sapiens
gcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgtttgtattttgggttggtttacactcgcacatactcagttttcagttttcccctttacagtcttctcccctcacctccaggaccctccccctttttaaaaaataaatcgctgacaagtgtgaatcccgtgaagactttattttgtgttgtgtgtatcctgtacagcaaggttggtccttggcatgttttgtatcagcgatcattctgaactgtacatatttatgttgcgagaggcaaagggcaagttttggattttgcttcttccaagtttgtttttaaacgacaaataaaaaaagaacattttaaata

SEQ ID NO: 287420 - DNA, 448 bp, Homo sapiens
gatgctgtctcttcattaattcggaacaagatccacaggctgccagttattgacccagaatcaggcaatactttgtacatcctcacccacaagcgcattctgaagttcctcaaattgtttgtaagtgctcctcagcccagttcttttttctcttttttcattgattgattgattgattgattgaaaagagagacgaggtctcactgtgttgctcaggctagtgtcaaactcctgagctcaagtgatcctcccgcctcagcctcccaaagtgctaggattacaggtgtgagccactgcatccagccccacttcttatttatttattaatttattttgagacaagttcttactctgttgcccaggctggcgtgcagaggcgctatcatggctcactgcagcctccaacctcttggtctcaggtgacccccgacctcaacccccagaagag

SEQ ID NO: 287421 - DNA, 2895 bp, Homo sapiens
gcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgtttgtattttgggttggtttacactcgcacatactcagttttcagttttcccctttacagtcttctcccctcacctccaggaccctccccctttttaaaaaataaatcgctgacaagtgtgaatcccgtgaagactttattttgtgttgtgtgtatcctgtacagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaatacaagcggctccgtcccatgaccctcgccgtcagccggatccgtgcggtccgcgaggacccgggggagggcggttaccgaggcccgccaccgccggaagggtgggttccttgccttccgccccagtctggcgactgccatgacgtgggcggaagtggcgtcgccgcagcggggatgtggggcggggcctgccccaagagagtttcctaaagcgaggaaaccaagccgggcgcctcttgcaatggagacggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacga

SEQ ID NO: 287422 - DNA, 2711 bp, Homo sapiens
gcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggttggttttttttttaagtaccctgcctgtataattgcatcagaatcccccaccccaccccccgcccccgtgtttgtattttgggttggtttacactcgcacatactcagttttcagttttcccctttacagtcttctcccctcacctccaggaccctccccctttttaaaaaataaatcgctgacaagtgtgaatcccgtgaagactttattttgtgttgtgtgtatcctgtacagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaatacaagcggctccgtcccatgaccctcgccgtcagccggatccgtgcggtccgcgaggacccgggggagggcggttaccgaggcccgccaccgccggaagggtgggttccttgccttccgccccagtctggcgactgccatgacgtgggcggaagtggcgtcgccgcagcggggatgtggggcggggcctgccccaagagagtttcctaaagcgaggaaaccaagccgggcgcctcttgcaatggagacggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacga

SEQ ID NO: 287423 - DNA, 1704 bp, Homo sapiens
atccttaattaaattaatcttccccccccgctgccccaagagagtttcctaaagcgaggaaaccaagccgggcgcctcttgcaatggagacggtcatttcttcagatagctccccagctgtggaaaatgagcatcctcaagagaccccagaatccaacaatagcgtgtatacttccttcatgaagtctcatcgctgctatgacctgattcccacaagctccaaattggttgtatttgatacgtccctgcaggtgaagaaagctttttttgctttggtgactaacggtgtacgagctgcccctttatgggatagtaagaagcaaagttttgtgggcatgctgaccatcactgatttcatcaatatcctgcaccgctactataaatcagccttggtacagatctatgagctagaagaacacaagatagaaacttggagagaggtgtatctccaggactcctttaaaccgcttgtctgcatttctcctaatgccagcttgtttgatgctgtctcttcattaattcggaacaagatccacaggctgccagttattgacccagaatcaggcaatactttgtacatcctcacccacaagcgcattctgaagttcctcaaattgtttatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaaggggcgtgtggtggacatctactccaagtttgatgttatcaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacga

SEQ ID NO: 287424 - DNA, 1384 bp, Homo sapiens
gagctgtgcttggggcggggcctggcgtgtattcgaaaggaaggcgccggctgcgggaagatggcggctcagccgctgcggcatcgctcacgttgtgcaacgccgccccggggggacttttgtggtggcactgagagggcgattgaccaagcttcttttacgacctccatggagtgggatacgcaggtggtgaaggggtcctcgccgctcggccccgcagggctgggggctgaggagccagccgccggcccgcagctgccgtcttggctgcagcctgagaggtgcgctgtgttccagtgcgcacagtgtcacgcagtgctcgccgactcggtgcacctcgcctgggacctgtcgcggtccctcggggccgtggtcttctccagagttacaaataacgtcgttttggaagcgcccttcctagttggcattgaaggttcactcaaaggcagtacttacaaccttttattctgtggttcttgtgggattcccgttggtttccatctgtattctacccatgctgccctggctgccttgagaggtcacttctgcctttccagtgacaaaatggtgtgctatctcttaaaaacaaaagccatagtaaatgcatcagagatggatattcaaaatgttcctctatcagaaaagattgcagagctgaaagagaagatagtgctaacgcacaatcgcttaaaatcactaatgaagattctgagtgaagtgactcctgaccagtccaagccagaaaactgatcctgtaccaaagcttgagtgtcaggttcaggctttattgctgtcttcaacaacaggtgctgcttagtcatttcttgaaaaagattggcttcaagaatggaggggaaatgcagtttctatttacctttaggctgattttccaaattatttgtgaagctgtttttagaagatgagagactaaggattcttctcttttatagctatttgccttaagaacttactttagattcttattgaattcataatacttatctctgaaaatgtctttgactgtaaatttaggaattaagatgcagagtcccatgtgtcctctgatctaaagttgcatggttggtctgaaaatagagttgggcttaatgttgacttctattactcctgcatggagcagttgttatgaatactaatacatcactttttaacttctgtaaaatacagatcataatattctataggtaatgtttaataaattgcctgaataatatacaatttgtctttttcagttgtaaactgaggttaacagagaaataatgaaagcaatgataaaacgaaacagttaccaaagtactattttctataattttgttttatgtagcactttgagtaacttatcaaaatattaatttaatatatattt

SEQ ID NO: 287425 - DNA, 1051 bp, Homo sapiens
gagctgtgcttggggcggggcctggcgtgtattcgaaaggaaggcgccggctgcgggaagatggcggctcagccgctgcggcatcgctcacgttgtgcaacgccgccccggggggacttttgtggtggcactgagagggcgattgaccaagcttcttttacgacctgtcgcggtccctcggggccgtggtcttctccagagttacaaataacgtcgttttggaagcgcccttcctagttggcattgaaggttcactcaaaggcagtacttacaaccttttattctgtggttcttgtgggattcccgttggtttccatctgtattctacccatgctgccctggctgccttgagaggtcacttctgcctttccagtgacaaaatggtgtgctatctcttaaaaacaaaagccatagtaaatgcatcagagatggatattcaaaatgttcctctatcagaaaagattgcagagctgaaagagaagatagtgctaacgcacaatcgcttaaaatcactaatgaagattctgagtgaagtgactcctgaccagtccaagccagaaaactgatcctgtaccaaagcttgagtgtcaggttcaggctttattgctgtcttcaacaacaggtgctgcttagtcatttcttgaaaaagattggcttcaagaatggaggggaaatgcagtttctatttacctttaggctgattttccaaattatttgtgaagctgtttttagaagatgagagactaaggattcttctcttttatagctatttgccttaagaacttactttagattcttattgaattcataatacttatctctgaaaatgtctttgactgtaaatttaggaattaagatgcagagtcccatgtgtcctctgatctaaagttgcatggttggtctgaaaatagagttgggcttaatgttgacttctattactcctgcatggagcagttgttatgaatactaatacatcactttttaacttctgtaaaatacagatcataatattctataggtaatgtttaataaattgcctgaataatataca

SEQ ID NO: 287426 - DNA, 1782 bp, Homo sapiens
ccaggcagaggggctcctcacatcccagacgatgggtggccaggcagagacgctcctcacttcccagacggggtggcggctgggcagaggctgtaatctcggcactttgggaggccaaggcaggcggctgggaggtggaggttgtagcgagccaagatcatgccactgcactccagcctgggcaccattgagcactgagtgaacgagacgagactccgtctgcaatcccggcaccctgggaggccgaggctggtggatcactcgcggttaggagctggagaccagcccagccaacacagcgaaaccccgtctccaccaaaaaaatatgaaaacctgtcaagtgtggcggcgcgtgcctgcaatcgcaggcactcggcaggctgaggcaggagaatcaggcagggaggttgcagtgagccgagatggcagcagtacagtccagctttggcttggcatcagagggagaccgtggaaagagagggagagggagaccgtggggagaggagggagagggagagggcgcatttttttcattaactttcttttttaatataagcaaaagacaaaccttgattttagttctatgaacaatttgtttagtaaggccccagtcaacttgattatttttcaacaactgtgaatttatataatgatagccattttacatgatttgtagttttaaatgtttaaatgttaatcagattagttagctctttttgtgtttattaggggtaaattacctttctcttctgaagcgacaattatacatccatgattgctttgaccagaatatacgagggtatccgcaatccagcatgtaattaaattacaatctgagttaccctttcttgaatgtgacattctttccgtctcattcctattacaatgtaattttcaccctgacttaggtgttaggaatgcttcagagactagttattttttatttcttatatgattttttattcttacccatattgtgtttttccccacccctagtacttacaaccttttattctgtggttcttgtgggattcccgttggtttccatctgtattctacccatgctgccctggctgccttgagaggtcacttctgcctttccagtgacaaaatggtgtgctatctcttaaaaacaaaagccatagtaaatgcatcagagatggatattcaaaatgttcctctatcagaaaagattgcagagctgaaagagaagatagtgctaacgcacaatcgcttaaaatcactaatgaagattctgagtgaagtgactcctgaccagtccaagccagaaaactgatcctgtaccaaagcttgagtgtcaggttcaggctttattgctgtcttcaacaacaggtgctgcttagtcatttcttgaaaaagattggcttcaagaatggaggggaaatgcagtttctatttacctttaggctgattttccaaattatttgtgaagctgtttttagaagatgagagactaaggattcttctcttttatagctatttgccttaagaacttactttagattcttattgaattcataatacttatctctgaaaatgtctttgactgtaaatttaggaattaagatgcagagtcccatgtgtcctctgatctaaagttgcatggttggtctgaaaatagagttgggcttaatgttgacttctattactcctgcatggagcagttgttatgaatactaatacatcactttttaacttctgtaaaatacagatcataatattctataggtaatgtttaataaattgcctgaataatataca

SEQ ID NO: 287427 - DNA, 1488 bp, Homo sapiens
ccaggcagaggggctcctcacatcccagacgatgggtggccaggcagagacgctcctcacttcccagacggggtggcggctgggcagaggctgtaatctcggcactttgggaggccaaggcaggcggctgggaggtggaggttgtagcgagccaagatcatgccactgcactccagcctgggcaccattgagcactgagtgaacgagacgagactccgtctgcaatcccggcaccctgggaggccgaggctggtggatcactcgcggttaggagctggagaccagcccagccaacacagcgaaaccccgtctccaccaaaaaaatatgaaaacctgtcaagtgtggcggcgcgtgcctgcaatcgcaggcactcggcaggctgaggcaggagaatcaggcagggaggttgcagtgagccgagatggcagcagtacagtccagctttggcttggcatcagagggagaccgtggaaagagagggagagggagaccgtggggagaggagggagagggagagggcgcatttttttcattaactttcttttttaatataagcaaaagacaaaccttgattttagttctatgaacaatttgtttagtaaggccccagtcaacttgattatttttcaacaactgtgaatttatataatgatagccattttacatgatttgtagttttaaatgtttaaatgttaatcagattagttagctctttttgtgtttattaggggtaaattacctttctcttctgaagcgacaattatacatccatgattgctttgaccagaatatacgagggtatccgcaatccagcatgtaattaaattacaatctgagttaccctttcttgaatgtgacattctttccgtctcattcctattacaatgtaattttcaccctgacttaggtgttaggaatgcttcagagactagttattttttatttcttatatgattttttattcttacccatattgtgtttttccccacccctagtacttacaaccttttattctgtggttcttgtgggattcccgttggtttccatctgtattctacccatgctgccctggctgccttgagaggtcacttctgcctttccagtgacaaaatggtgtgctatctcttaaaaacaaaagccatagtaaatgcatcagagatggatattcaaaatgttcctctatcagaaaagattgcagaggtaaaatttcatgatggttgtatgcttttttaaaatacagacaactcttgataacttctaccaatgaacttggggatgatgaaatggcatgatgctcaataatcctttttacttgatttgaccttccctattgaatttgtaatgaaaaacaaaatactaaaaccacactgtaaggtatagttcaggaagaaaggaaaagctgctcaactgctgcactcctgcattctcctttgtgctgggaatggatatcatcatcttgccatagaggtgtcttctttgcaaatacc

SEQ ID NO: 287428 - DNA, 1235 bp, Homo sapiens
gagctgtgcttggggcggggcctggcgtgtattcgaaaggaaggcgccggctgcgggaagatggcggctcagccgctgcggcatcgctcacgttgtgcaacgccgccccggggggacttttgtggtggcactgagagggcgattgaccaagcttcttttacgacctccatggagtgggatacgcaggtggtgaaggggtcctcgccgctcggccccgcagggctgggggctgaggagccagccgccggcccgcagctgccgtcttggctgcagcctgagaggtgcgctgtgttccagtgcgcacagtgtcacgcagtgctcgccgactcggtgcacctcgcctgggacctgtcgcggtccctcggggccgtggtcttctccagagttacaaataacgtcgttttggaagcgcccttcctagttggcattgaaggttcactcaaaggcagtacttacaaccttttattctgtggttcttgtgggattcccgttggtttccatctgtattctacccatgctgccctggctgccttgagaggtcacttctgcctttccagtgacaaaatggtgtgctatctcttaaaaacaaaagccatagtaaatgcatcagagatggatattcaaaatgttcctctatcagaaaagattgcagagctgaaagagaagatagtgctaacgcacaatcgcttaaaatcactaatgaagattctgagtgaagtgactcctgaccagtccaagccagaaaactgatcctgtaccaaagcttgagtgtcaggttcaggctttattgctgtcttcaacaacaggtgctgcttagtcatttcttgaaaaagattggcttcaagaatggaggggaaatgcagtttctatttacctttaggctgattttccaaattatttgtgaagctgtttttagaagatgagagactaaggattcttctcttttatagctatttgccttaagaacttactttagattcttattgaattcataatacttatctctgaaaatgtctttgactgtaaatttaggaattaagatgcagagtcccatgtgtcctctgatctaaagttgcatggttggtctgaaaatagagttgggcttaatgttgacttctattactcctgcatggagcagttgttatgaatactaatacatcactttttaacttctgtaaaatacagatcataatattctataggtaatgtttaataaattgcctgaataatataca

SEQ ID NO: 287429 - DNA, 1112 bp, Homo sapiens
gagctgtgcttggggcggggcctggcgtgtattcgaaaggaaggcgccggctgcgggaagatggcggctcagccgctgcggcatcgctcacgttgtgcaacgccgccccggggggacttttgtggtggcactgagagggcgattgaccaagcttcttttacgacctccatggagtgggatacgcaggtggtgaaggggtcctcgccgctcggccccgcagggctgggggctgaggagccagccgccggcccgcagctgccgtcttggctgcagcctgagaggtgcgctgtgttccagtgcgcacagtgtcacgcagtgctcgccgactcggtgcacctcgcctgggacctgtcgcggtccctcggggccgtggtcttctccagagttacaaataacgtcgttttggaagcgcccttcctagttggcattgaaggttcactcaaaggcagctatctcttaaaaacaaaagccatagtaaatgcatcagagatggatattcaaaatgttcctctatcagaaaagattgcagagctgaaagagaagatagtgctaacgcacaatcgcttaaaatcactaatgaagattctgagtgaagtgactcctgaccagtccaagccagaaaactgatcctgtaccaaagcttgagtgtcaggttcaggctttattgctgtcttcaacaacaggtgctgcttagtcatttcttgaaaaagattggcttcaagaatggaggggaaatgcagtttctatttacctttaggctgattttccaaattatttgtgaagctgtttttagaagatgagagactaaggattcttctcttttatagctatttgccttaagaacttactttagattcttattgaattcataatacttatctctgaaaatgtctttgactgtaaatttaggaattaagatgcagagtcccatgtgtcctctgatctaaagttgcatggttggtctgaaaatagagttgggcttaatgttgacttctattactcctgcatggagcagttgttatgaatactaatacatcactttttaacttctgtaaaatacagatcataatattctataggtaatgtttaataaattgcctgaataatataca

SEQ ID NO: 287430 - DNA, 1012 bp, Homo sapiens
tcctactcgcacagcccagggagtggggaggataaggcgctgtcatggaggacgccgccgcgccggggcggaccgagggggtccttgaaaggcaaggagcgccgccagctgcaggccagggaggagccctggtggagctcaccccgacccccggcggcctggccctggtgagcccctaccacacccaccgggccggggaccccttagacctcgtggcgctcgcagagcaggtgcagaaggctgatgaattcatccgagcaaatgccaccaacaagctgacagtcatagctgagcaaatccaacatttgcaagaacaagccaggaaggtactggaagatgctcacagagatgccaacctgcaccatgtagcttgtaatatagtgaaaaaacctggcaacatttactatctctataaacgggagagtggtcagcagtatttttccatcatttctccaaaggaatgggggacaagttgtccacatgacttccttggtgcctacaaactacagcatgacttgtcctggactccgtatgaggacattgagaagcaagatgctaaaatcagcatgatggacacgttgctaagccagtcagtggccctgcctccgtgcactgaacccaacttccagggactgactcactgagagtgggctttgacaaacagctctcacaggacctggctgtcaacctccttgttgcccccactgttgccttgagaattgaagacatgtaggtgactcacaaacttcttggaaagagaccctgtgtgaatgtaaatgctgtcattatgacttttaattgggatgggaataatcattgagacagagtcactgtctttcgggatcctctttggaccacagatacccaagtcagtcagtttcagagtattggccagtgtactttccttcttcctctccatcacttcttcccttaagttaaagtgttagagaagaccttcttcccataaaaaggttggtggatcgttttccagagagaactgttttcagtcttt

SEQ ID NO: 287431 - DNA, 795 bp, Homo sapiens
ctaaaaatacaaaaaattagccgggcatggtggcagacgcccgtaattccagctactcatgaggctgaggccggagaatcacttgaacctgggaggcagatgttgcagtgagtggagattgtgccacttcactccagcctgggtgacaaggctgatgaattcatccgagcaaatgccaccaacaagctgacagtcatagctgagcaaatccaacatttgcaagaacaagccaggaaggtactggaagatgctcacagagatgccaacctgcaccatgtagcttgtaatatagtgaaaaaacctggcaacatttactatctctataaacgggagagtggtcagcagtatttttccatcatttctccaaaggaatgggggacaagttgtccacatgacttccttggtgcctacaaactacagcatgacttgtcctggactccgtatgaggacattgagaagcaagatgctaaaatcagcatgatggacactgttgccttgagaattgaagacatgtaggtgactcacaaacttcttggaaagagaccctgtgtgaatgtaaatgctgtcattatgacttttaattgggatgggaataatcattgagacagagtcactgtctttcgggatcctctttggaccacagatacccaagtcagtcagtttcagagtattggccagtgtactttccttcttcctctccatcacttcttcccttaagttaaagtgttagagaagaccttcttcccataaaaaggttggtggatcgttttccagagagaactgttttcagtcttt

SEQ ID NO: 287432 - DNA, 853 bp, Homo sapiens
tcctactcgcacagcccagggagtggggaggataaggcgctgtcatggaggacgccgccgcgccggggcggaccgagggggtccttgaaaggcaaggagcgccgccagctgcaggccagggaggtactggaagatgctcacagagatgccaacctgcaccatgtagcttgtaatatagtgaaaaaacctggcaacatttactatctctataaacgggagagtggtcagcagtatttttccatcatttctccaaaggaatgggggacaagttgtccacatgacttccttggtgcctacaaactacagcatgacttgtcctggactccgtatgaggacattgagaagcaagatgctaaaatcagcatgatggacacgttgctaagccagtcagtggccctgcctccgtgcactgaacccaacttccagggactgactcactgagagtgggctttgacaaacagctctcacaggacctggctgtcaacctccttgttgcccccactgttgccttgagaattgaagacatgaaatgccactatgcctcccggatgctcctggtcagcttcctgttagacatggcagtcagggcaatgaccagccacatcaacatatgctccaaattgggagccgagctgaatgactttgccgtcttcaccaccttcggcttggcctccgctctgctcctaggcgtggatggacttctgagtgggatcctggccatcatctatgtgtcagctgcttctttccacttgtgcttttattcacctggagtcccctccacatacaagggtctaccctgcccctatgcttcctgcatcttggcttccacctcccttctgaccaaaggcaacag

SEQ ID NO: 287433 - DNA, 1256 bp, Homo sapiens
tcctactcgcacagcccagggagtggggaggataaggcgctgtcatggaggacgccgccgcgccggggcggaccgagggggtccttgaaaggcaaggagcgccgccagctgcaggccagggaggagccctggtggagctcaccccgacccccggcggcctggccctggtgagcccctaccacacccaccgggccggggaccccttagacctcgtggcgctcgcagagcaggtgcagaaggctgatgaattcatccgagcaaatgccaccaacaagctgacagtcatagctgagcaaatccaacatttgcaagaacaagccaggaaggtactggaagatgctcacagagatgccaacctgcaccatgtagcttgtaatatagtgaaaaaacctggcaacatttactatctctataaacgggagagtggtcagcagtatttttccatcatttctccaaaggaatgggggacaagttgtccacatgacttccttggtgcctacaaactacagcatgacttgtcctggactccgtatgaggacattgagaagcaagatgctaaaatcagcatgatggacacgttgctaagccagtcagtggccctgcctccgtgcactgaacccaacttccagggactgactcactgagagtgggctttgacaaacagctctcacaggacctggctgtcaacctccttgttgcccccactgttgccttgagaattgaagacatgtaggtgactcacaaacttcttggaaagagaccctgtgtgaatgtaaatgctgtcattatgacttttaattgggatgggaataatcattgagacagagtcactgtctttcgggatcctctttggaccacagatacccaagtcagtcagtttcagagtattggccagtgtactttccttcttcctctccatcacttcttcccttaagttaaagtgttagagaagaccttcttcccataaaaaggttggtggatcgttttccagagagaactgttttcagtcttttatatatatatatatatatatatatataactggtagtatttaacattggggttgaggctgtctcacagttggtgcaactccagtttaaaattcatctgggaacgagaatgttgagtaatggagggtgatttaaaaaacaacaacaacaacaaaaaaaaaaacacttggcttggctggaccagagagtgtgtgattctgggatttctgtgctgttgatgaggtttgtcttgccccttttgctctc

SEQ ID NO: 287434 - DNA, 1180 bp, Homo sapiens
gcggtgactctacaggatccctcataggttcgcaggaggaaaaatggattggttggaggagaggatatattcagtatatttggtagcaggagagagaaagagagaaggcatgctggagaaccaaagaagttcagtgtaactgcagttcatagcgaaggggtggaaagctatgggaaatagaagagagcacttaactctgtggcgtggagtcatgtcagggtggccttctcatgacagtgctatctgagtggggcctcggatgagtgggaggctatggggcagtggcaagaatgggaaaaatattttaggcagaagcaaaatattaacataaccctgggatcaagataagaacatcatagaagtcttttcctctttcaacccacagtttagttttttctcacctgtaggctgatgaattcatccgagcaaatgccaccaacaagctgacagtcatagctgagcaaatccaacatttgcaagaacaagccaggaaggtactggaagatgctcacagagatgccaacctgcaccatgtagcttgtaatatagtgaaaaaacctggcaacatttactatctctataaacgggagagtggtcagcagtatttttccatcatttctccaaaggaatgggggacaagttgtccacatgacttccttggtgcctacaaactacagcatgacttgtcctggactccgtatgaggacattgagaagcaagatgctaaaatcagcatgatggacacgttgctaagccagtcagtggccctgcctccgtgcactgaacccaacttccagggactgactcactgagagtgggctttgacaaacagctctcacaggacctggctgtcaacctccttgttgcccccactgttgccttgagaattgaagacatgtaggtgactcacaaacttcttggaaagagaccctgtgtgaatgtaaatgctgtcattatgacttttaattgggatgggaataatcattgagacagagtcactgtctttcgggatcctctttggaccacagatacccaagtcagtcagtttcagagtattggccagtgtactttccttcttcctctccatcacttcttcccttaagttaaagtgttagagaagaccttcttcccataaaaaggttggtggatcgttttccagagagaactgttttcagtcttt

SEQ ID NO: 287435 - DNA, 631 bp, Homo sapiens
ttgtggcatgattaggaaatgagctcagtttgtttacaacccacgctgatgggaactgcctcctttgccttctctaggaatgggggacaagttgtccacatgacttccttggtgcctacaaactacagcatgacttgtcctggactccgtatgaggacattgagaagcaagatgctaaaatcagcatgatggacacgttgctaagccagtcagtggccctgcctccgtgcactgaacccaacttccagggactgactcactgagagtgggctttgacaaacagctctcacaggacctggctgtcaacctccttgttgcccccactgttgccttgagaattgaagacatgtaggtgactcacaaacttcttggaaagagaccctgtgtgaatgtaaatgctgtcattatgacttttaattgggatgggaataatcattgagacagagtcactgtctttcgggatcctctttggaccacagatacccaagtcagtcagtttcagagtattggccagtgtactttccttcttcctctccatcacttcttcccttaagttaaagtgttagagaagaccttcttcccataaaaaggttggtggatcgttttccagagagaactgttttcagtcttt

SEQ ID NO: 287436 - DNA, 896 bp, Homo sapiens
tcctactcgcacagcccagggagtggggaggataaggcgctgtcatggaggacgccgccgcgccggggcggaccgagggggtccttgaaaggcaaggagcgccgccagctgcaggccagggaggctgatgaattcatccgagcaaatgccaccaacaagctgacagtcatagctgagcaaatccaacatttgcaagaacaagccaggaaggtactggaagatgctcacagagatgccaacctgcaccatgtagcttgtaatatagtgaaaaaacctggcaacatttactatctctataaacgggagagtggtcagcagtatttttccatcatttctccaaaggaatgggggacaagttgtccacatgacttccttggtgcctacaaactacagcatgacttgtcctggactccgtatgaggacattgagaagcaagatgctaaaatcagcatgatggacacgttgctaagccagtcagtggccctgcctccgtgcactgaacccaacttccagggactgactcactgagagtgggctttgacaaacagctctcacaggacctggctgtcaacctccttgttgcccccactgttgccttgagaattgaagacatgtaggtgactcacaaacttcttggaaagagaccctgtgtgaatgtaaatgctgtcattatgacttttaattgggatgggaataatcattgagacagagtcactgtctttcgggatcctctttggaccacagatacccaagtcagtcagtttcagagtattggccagtgtactttccttcttcctctccatcacttcttcccttaagttaaagtgttagagaagaccttcttcccataaaaaggttggtggatcgttttccagagagaactgttttcagtcttt

SEQ ID NO: 287437 - DNA, 4451 bp, Homo sapiens
ctctttatacttttgtattgtttaattttttttaacagttgtcttgttttttcttctgcagtgaaaataatggtgacaagaagcccactgcctgattcacataagcaaggcatgctgcagggaagacagggttcttattaatatttcctttcatgtgcttacatatgagttacagttgctaatcctttcccacagtttagcacctagttaaaagaaagggcttcggaatcaggtaagtgtagattaaagttataacggcaaattgctgaacctttggaagcctcggtttttccacctggaaaatggatttttatcttacaggactgtcgtgaggattgatgagctaacattcctaaatcagggagtttgaagtctggcccagggtattttcctcctttcctgaaataatgtgtagttctgaccaagtgagaagaatcataagaatatgggattttgaaaaacatgaaaacatcctaagaaataccaggaaggagtcccacagtgaagcacaaatgaaactcaagatgactgcctaaaataagaaatcatggatcttaggagaaagggggcaaggaagtaaatcaaaggacaaagctgaagaccaagtggaccgaaaagaagatggaatacattttcccaaacactggtgttctctggagttggcttatcaacatcttgtgcaatcggaggatcgtgtggtttacttccagccagctgccccgtggtcctccagccagctccgggggccacagttttcacacgctccgggagcgatccgagagccgccttttcgtggaaagttacgctgccgcctggcaacccccgggaacgtcgggaggggcaagttgctgctcatccctcagtgctcaagtcatgagtagcgaattcctggctgagctgcactgggaggatgggttcgccatcccggtggcgaacgaggagaacaagctactggaagatcagttgtcaaagctgaaggatgaaagagcaagcttgcaagatgagttacgtgagtatgaagagcgaattaattctatgacttctcacttcaaaaatgttaagcaagagctctcaattacacagtctctttgcaaagcaagggagcgtgagactgaaagtgaagaacattttaaggccattgctcaaagagaattgggacgagtgaaagatgaaattcaacggctggaaaatgagatggcttcaatactggaaaagaaaagtgataaagaaaatggcatatttaaagccactcaaaaattggatggtttgaaatgtcaaatgaactgggaccagcaagcattggaggcctggttagaagaatcagctcataaagatagtgatgctctcactctccagaagtatgcacaacaagatgataataaaatcagggcactgactctgcaattagaaagactaactttggaatgtaatcagaaaagaaagatacttgacaacgaacttacagagactataagcgcacagttagaattggataaagcagcacaagattttcgtaagattcataatgaaagacaagaactcattaaacaatgggagaacacaatagaacagatgcagaagagggatggagacatagataactgtgctttggaattagcaaggataaagcaggaaacgagagaaaaagaaaatttggttaaagaaaagatcaagtttttggaaagtgagattgggaataacacagagtttgagaaaagaatttctgtggctgatcgtaaacttttaaaatgtagaacggcatatcaggaccatgaaactagtagaattcagctgaagggtgagctggattctttaaaagccactgtgaatagaacttccagtgatttagaagctctgaggaaaaatatttccaagataaagaaggacattcatgaagaaacagcaaggttacaaaaaactaaaaatcataatgagataatacaaacaaaattaaaggagataactgagaaaaccatgtctgtagaagagaaagctactaatttggaagatatgctaaaggaggaggaaaaagatgtgaaggaagtagatgttcaactgaacctcataaaaggtgtgctgtttaagaaagctcaggagttacagactgagacaatgaaagaaaaagctgttttatcagaaattgaaggaactcgttcctctctgaaacatctcaaccatcagttacaaaaactggattttgaaaccttgaagcagcaagaaattatgtacagccaggattttcacattcaacaagtggaacggagaatgtcacggttaaagggagaaattaattcagaagaaaaacaagcgcttgaagcaaaaattgttgaacttaggaagtctttggaagagaaaaaatctacatgtggccttttggaaacacagatcaagaagcttcataatgatctttattttatcaagaaggcacatagtaaaaacagtgatgaaaaacagtcccttatgaccaaaataaatgaactaaaccttttcatcgacagatcagagaaagaacttgataaagccaaaggttttaagcaggatttgatgatagaggacaatcttttaaaacttgaagttaagcgtactcgagaaatgcttcacagtaaggcagaagaagttctttccctagaaaaaagaaaacagcaattatacacagcaatggaagagcgaactgaagaaatcaaggttcataaaacaatgcttgcgtcacaaataagatatgttgatcaagaacgggaaaacataagcactgagtttcgcgagcggctaagtaaaattgagaagctgaagaatagatatgaaattctgactgttgttatgctgcctcctgaaggagaagaggagaaaacacaggcctattatgtaataaaggtgatgagtatgagctaaaaattcaactagaagaacaaaaaagagctgttgatgaaaaatacagatacaaacaaagacaaatcagagaacttcaagaagacatccagagcatggaaaatacattagatgttatagaacatttggcaaataatgttaaagaaaagttatcagagaagcaggcttattcatttcaactaagtaaagaaacggaggagcagaagccaaaattagaaagagtgaccaaacagtgtgcaaaactcacaaaggaaatccgtcttttgaaagacacaaaagatgaaacaatggaagaacaagacatcaaacttcgtgaaatgaaacagtttcacaaagttattgatgaaatgttagttgatatcatagaagaaaatactgagatccgtattatccttcaaacatactttcaacagagtgggttagaactacctacagctagcacaaaaggcagtcgtcagagctctagatctccttcacatacttcactatcagcaaggtcatctaggagtacaagtacatctacttctcagtcttcaattaaagtactggagcttaaattcccggcctcctcttcactagtaggcagcccttctaggccatctagtgctagtagtagctctagtaatgttaagagcaaaaagagcagcaaataaacattttaatctcttctgaaaaagttgtaaacacaaaaacaaaaatatactttaaaatacaaaacgacccaacacattttatctagtggaaagtgtaaaaacttagtggtaagtgtaaaaactgatagttttaaaaaaaaaggaacgttctcattttctctactgttttcttcatactgaagaaattaatagcagattcttgacaaggctacatgttatacaagcataggaaaaatgctgtatttcactgtaattctgatgttcgtagtgttagaaaatagtttgcttcattatttcacgaaactacactcacttctaatgtaacaatctttcaagaagaaatttctaaagatttactgtactattatgagcgtattgcaatgtgaaaatctcatttaccctacaagacaccaaaattaggttttctttattcaaagtaactatttctcagacttttggggagaaaaattgttaaaggcagtttcttcttttgctataatttttaaccaaaaaatagcatcaacccctacccaccccacccccccaaaaaaaaaccggtaagagaaacactgtatatcaattttaaaatgcagcataaatttagaaaaatcacttctgaccttgaaataaatcacttctgaccttgaaataaacgcattaaagatttgctttcagatacagccaaccaagtataaacaattttgaaattttcttgatttaataaacgatttaatgaaagctaggtatgacttgatttgcaatagaaatttcatttacagttggaggtagactgccaaatgtagtagtttttccagttaacacttcattataacatgtgcccaacactttgtactcttggaatagagtgtggaatattataaaactggattttaaataaatgtattagaattc

SEQ ID NO: 287438 - DNA, 2230 bp, Homo sapiens
cataaatcagtaatatcttttattatcactatcaagtattatgcactgtacataattgtatgtgctagacttttatatgactggcaatgcaggtttgtttacaccagccatcaccacaaactcatgactaatgtattgtgccacattacaatgtcgctaggtaacaggaatttttcagctccattataatcctatgggaccaccatcatatatacagtccatcattgaccgagatgtcattaagaggtacatcaacagaaataatgtatattatgtacaaaaataaatgaattaaaattaaatgaatacttgataaatgacaagttataaaagtcaatttctgattctaaaaaatacatgttaatattttttctacagagcatggaaaatacattagatgttatagaacatttggcaaataatgttaaagaaaagttatcagagaagcaggcttattcatttcaactaagtaaagaaacggaggagcagaagccaaaattagaaagagtgaccaaacaggtatcgatatcttttaaaaactgacctttcatatttacatttttgaagtcccaaatcctccttcatctattaaaaatattaaattctggtaaacacgtttatagaataattgactattatttaccaacagtgtgcaaaactcacaaaggaaatccgtcttttgaaagacacaaaagatgaaacaatggaagaacaagacatcaaacttcgtgaaatgaaacagtttcacaaagttattgatgaaatgttagttgatatcatagaagaaaatactgagatccgtattatccttcaaacatactttcaacaggtaatacagcaccttctattaaatatttcttaaaaacttcatgaaaataaaaactttcatgacattcatcatgaagtgaaagctaattaaaaatatttatcttctaaaaaacagtaggtagtactaatgattgctattgaatattcctccagagtgggttagaactacctacagctagcacaaaaggcagtcgtcagagctctagatctccttcacatacttcactatcagcaaggtcatctaggagtacaagtacatctacttctcagtcttcaattaaagtactggagcttaaattcccggcctcctcttcactagtaggcagcccttctaggccatctagtgctagtagtagctctagtaatgttaagagcaaaaagagcagcaaataaacattttaatctcttctgaaaaagttgtaaacacaaaaacaaaaatatactttaaaatacaaaacgacccaacacattttatctagtggaaagtgtaaaaacttagtggtaagtgtaaaaactgatagttttaaaaaaaaaggaacgttctcattttctctactgttttcttcatactgaagaaattaatagcagattcttgacaaggctacatgttatacaagcataggaaaaatgctgtatttcactgtaattctgatgttcgtagtgttagaaaatagtttgcttcattatttcacgaaactacactcacttctaatgtaacaatctttcaagaagaaatttctaaagatttactgtactattatgagcgtattgcaatgtgaaaatctcatttaccctacaagacaccaaaattaggttttctttattcaaagtaactatttctcagacttttggggagaaaaattgttaaaggcagtttcttcttttgctataatttttaaccaaaaaatagcatcaacccctacccaccccacccccccaaaaaaaaaccggtaagagaaacactgtatatcaattttaaaatgcagcataaatttagaaaaatcacttctgaccttgaaataaatcacttctgaccttgaaataaacgcattaaagatttgctttcagatacagccaaccaagtataaacaattttgaaattttcttgatttaataaacgatttaatgaaagctaggtatgacttgatttgcaatagaaatttcatttacagttggaggtagactgccaaatgtagtagtttttccagttaacacttcattataacatgtgcccaacactttgtactcttggaatagagtgtggaatattataaaactggattttaaataaatgtattagaattcacgaatgtacatgtgtctccttcaaaccttgggaaaaaatgctcattacaactgtcattattttagaactgttgtttgtacttctttctgaaaagca

SEQ ID NO: 287439 - DNA, 1492 bp, Homo sapiens
cataaatcagtaatatcttttattatcactatcaagtattatgcactgtacataattgtatgtgctagacttttatatgactggcaatgcaggtttgtttacaccagccatcaccacaaactcatgactaatgtattgtgccacattacaatgtcgctaggtaacaggaatttttcagctccattataatcctatgggaccaccatcatatatacagtccatcattgaccgagatgtcattaagaggtacatcaacagaaataatgtatattatgtacaaaaataaatgaattaaaattaaatgaatacttgataaatgacaagttataaaagtcaatttctgattctaaaaaatacatgttaatattttttctacagagcatggaaaatacattagatgttatagaacatttggcaaataatgttaaagaaaagttatcagagaagcaggcttattcatttcaactaagtaaagaaacggaggagcagaagccaaaattagaaagagtgaccaaacaggtatcgatatcttttaaaaactgacctttcatatttacatttttgaagtcccaaatcctccttcatctattaaaaatattaaattctggtaaacacgtttatagaataattgactattatttaccaacagtgtgcaaaactcacaaaggaaatccgtcttttgaaagacacaaaagatgaaacaatggaagaacaagacatcaaacttcgtgaaatgaaacagtttcacaaagttattgatgaaatgttagttgatatcatagaagaaaatactgagatccgtattatccttcaaacatactttcaacaggtaatacagcaccttctattaaatatttcttaaaaacttcatgaaaataaaaactttcatgacattcatcatgaagtgaaagctaattaaaaatatttatcttctaaaaaacagtaggtagtactaatgattgctattgaatattcctccagagtgggttagaactacctacagctagcacaaaaggcagtcgtcagagctctagatctccttcacatacttcactatcagcaaggtaagcggagggttaaaaaaaaatctgcttaactctcacagctgtacactaagtgattccagccacttcactgtcagacatctcactagtcagcatcatatagattagatgcagaaacagccagcagaacaagaatttccttctgacttctgctggtgtcactatttccagtatagcccaagtgctctgtgactatgagctatttcagtaggataaaacagaaataaatttgggggctacatctagcatttgggggtgaacccccaagttgggggaatttaaaaacatgtaagggcagcttagatgtacagacatatagaatatgatttttgtgattcaaaccacactgtggtattttacataatcaggatttgactttatgaagctttattttgctaaaaaggaaacccctttttttttcttctgca

SEQ ID NO: 287440 - DNA, 1183 bp, Homo sapiens
cataaatcagtaatatcttttattatcactatcaagtattatgcactgtacataattgtatgtgctagacttttatatgactggcaatgcaggtttgtttacaccagccatcaccacaaactcatgactaatgtattgtgccacattacaatgtcgctaggtaacaggaatttttcagctccattataatcctatgggaccaccatcatatatacagtccatcattgaccgagatgtcattaagaggtacatcaacagaaataatgtatattatgtacaaaaataaatgaattaaaattaaatgaatacttgataaatgacaagttataaaagtcaatttctgattctaaaaaatacatgttaatattttttctacagagcatggaaaatacattagatgttatagaacatttggcaaataatgttaaagaaaagttatcagagaagcaggcttattcatttcaactaagtaaagaaacggaggagcagaagccaaaattagaaagagtgaccaaacaggtatcgatatcttttaaaaactgacctttcatatttacatttttgaagtcccaaatcctccttcatctattaaaaatattaaattctggtaaacacgtttatagaataattgactattatttaccaacagtgtgcaaaactcacaaaggaaatccgtcttttgaaagacacaaaagatgaaacaatggaagaacaagacatcaaacttcgtgaaatgaaacagtttcacaaagttattgatgaaatgttagttgatatcatagaagaaaatactgagatccgtattatccttcaaacatactttcaacagagtgggttagaactacctacagctagcacaaaaggcagtcgtcagagctctagatctccttcacatacttcactatcagcaaggtcatctaggagtacaagtacatctacttctcagtcttcaattaaagtactggagcttaaattcccggcctcctcttcactaaaataggaaaaaggcatagcaaagtcaagaataaggtgggcgaaaaaaaagaagttgcaggtgcatctgatttccaggaaagtgcaaaaagcagatccgcttttttggagatgaatttctgtatctcgatgttgtcaactctcttctcttttcttaaaaagaaaaaaatatatatgaaaattgggaaaa

SEQ ID NO: 287441 - DNA, 3956 bp, Homo sapiens
tagggctcccccggcaattgccgcggcactgtgcaggtgcctgggcttgacgcgggtgctgctcacccgctgtacaagaaggcggatctttgctctgtatcttctctatccgtttgcagtcatgagtagcgaattcctggctgagctgcactgggaggatgggttcgccatcccggtggcgaacgaggagaacaagctactggaagatcagttgtcaaagctgaaggatgaaagagcaagcttgcaagatgagttacgtgagtatgaagagcgaattaattctatgacttctcacttcaaaaatgttaagcaagagctctcaattacacagtctctttgcaaagcaagggagcgtgagactgaaagtgaagaacattttaaggccattgctcaaagagaattgggacgagtgaaagatgaaattcaacggctggaaaatgagatggcttcaatactggaaaagaaaagtgataaagaaaatggcatatttaaagccactcaaaaattggatggtttgaaatgtcaaatgaactgggaccagcaagcattggaggcctggttagaagaatcagctcataaagatagtgatgctctcactctccagaagtatgcacaacaagatgataataaaatcagggcactgactctgcaattagaaagactaactttggaatgtaatcagaaaagaaagatacttgacaacgaacttacagagactataagcgcacagttagaattggataaagcagcacaagattttcgtaagattcataatgaaagacaagaactcattaaacaatgggagaacacaatagaacagatgcagaagagggatggagacatagataactgtgctttggaattagcaaggataaagcaggaaacgagagaaaaagaaaatttggttaaagaaaagatcaagtttttggaaagtgagattgggaataacacagagtttgagaaaagaatttctgtggctgatcgtaaacttttaaaatgtagaacggcatatcaggaccatgaaactagtagaattcagctgaagggtgagctggattctttaaaagccactgtgaatagaacttccagtgatttagaagctctgaggaaaaatatttccaagataaagaaggacattcatgaagaaacagcaaggttacaaaaaactaaaaatcataatgagataatacaaacaaaattaaaggagataactgagaaaaccatgtctgtagaagagaaagctactaatttggaagatatgctaaaggaggaggaaaaagatgtgaaggaagtagatgttcaactgaacctcataaaaggtgtgctgtttaagaaagctcaggagttacagactgagacaatgaaagaaaaagctgttttatcagaaattgaaggaactcgttcctctctgaaacatctcaaccatcagttacaaaaactggattttgaaaccttgaagcagcaagaaattatgtacagccaggattttcacattcaacaagtggaacggagaatgtcacggttaaagggagaaattaattcagaagaaaaacaagcgcttgaagcaaaaattgttgaacttaggaagtctttggaagagaaaaaatctacatgtggccttttggaaacacagatcaagaagcttcataatgatctttattttatcaagaaggcacatagtaaaaacagtgatgaaaaacagtcccttatgaccaaaataaatgaactaaaccttttcatcgacagatcagagaaagaacttgataaagccaaaggttttaagcaggatttgatgatagaggacaatcttttaaaacttgaagttaagcgtactcgagaaatgcttcacagtaaggcagaagaagttctttccctagaaaaaagaaaacagcaattatacacagcaatggaagagcgaactgaagaaatcaaggttcataaaacaatgcttgcgtcacaaataagatatgttgatcaagaacgggaaaacataagcactgagtttcgcgagcggctaagtaaaattgagaagctgaagaatagatatgaaattctgactgttgttatgctgcctcctgaaggagaagaggagaaaacacaggcctattatgtaataaaggctgctcaagaaaaagaagaacttcaaagggaaggtgactgtttggatgccaagatcaacaaagctgaaaaagaaatctacgctctagaaaatacccttcaagtgctgaacagctgtaacaacaattataagcaatcttttaaaaaagtgactccatctagtgatgagtatgagctaaaaattcaactagaagaacaaaaaagagctgttgatgaaaaatacagatacaaacaaagacaaatcagagaacttcaagaagacatccagagcatggaaaatacattagatgttatagaacatttggcaaataatgttaaagaaaagttatcagagaagcaggcttattcatttcaactaagtaaagaaacggaggagcagaagccaaaattagaaagagtgaccaaacagtgtgcaaaactcacaaaggaaatccgtcttttgaaagacacaaaagatgaaacaatggaagaacaagacatcaaacttcgtgaaatgaaacagtttcacaaagttattgatgaaatgttagttgatatcatagaagaaaatactgagatccgtattatccttcaaacatactttcaacagagtgggttagaactacctacagctagcacaaaaggcagtcgtcagagctctagatctccttcacatacttcactatcagcaaggtcatctaggagtacaagtacatctacttctcagtcttcaattaaagtactggagcttaaattcccggcctcctcttcactagtaggcagcccttctaggccatctagtgctagtagtagctctagtaatgttaagagcaaaaagagcagcaaataaacattttaatctcttctgaaaaagttgtaaacacaaaaacaaaaatatactttaaaatacaaaacgacccaacacattttatctagtggaaagtgtaaaaacttagtggtaagtgtaaaaactgatagttttaaaaaaaaaggaacgttctcattttctctactgttttcttcatactgaagaaattaatagcagattcttgacaaggctacatgttatacaagcataggaaaaatgctgtatttcactgtaattctgatgttcgtagtgttagaaaatagtttgcttcattatttcacgaaactacactcacttctaatgtaacaatctttcaagaagaaatttctaaagatttactgtactattatgagcgtattgcaatgtgaaaatctcatttaccctacaagacaccaaaattaggttttctttattcaaagtaactatttctcagacttttggggagaaaaattgttaaaggcagtttcttcttttgctataatttttaaccaaaaaatagcatcaacccctacccaccccacccccccaaaaaaaaaccggtaagagaaacactgtatatcaattttaaaatgcagcataaatttagaaaaatcacttctgaccttgaaataaatcacttctgaccttgaaataaacgcattaaagatttgctttcagatacagccaaccaagtataaacaattttgaaattttcttgatttaataaacgatttaatgaaagctaggtatgacttgatttgcaatagaaatttcatttacagttggaggtagactgccaaatgtagtagtttttccagttaacacttcattataacatgtgcccaacactttgtactcttggaatagagtgtggaatattataaaactggattttaaataaatgtattagaattcacgaatgtacatgtgtctccttcaaaccttgggaaaaaatgctcattacaactgtcattattttagaactgttgtttgtacttctttctgaaaagca

SEQ ID NO: 287442 - DNA, 1844 bp, Homo sapiens
cattcttgtgctttgctgacaaaaatttattaataatgatcctgattttagaattcacaatctcctgcattcagcagctacttattaaattactattccttagtccaggtaaaaatttcatgaagaggcccctaaaaaaagtgtttcatttaagtataaaaaactgtttctatataactgaacatccctgtactttcataaaatatatatttaaaacttttttcagaattatatagctagctgtttttcaaatgaccccaccactttatccatcaatatgcttctctcttctcttcagcttaaattacaaaaggtatcattttaattatttttgccagcaccaaatcctcttggccctatttcctctgttttggaaactttcaatgcttaatgattccaactctaaaaaactgattatagttcaaagcatttttaccatgtaggaacatacttattaaactacttttctactggtttgaaactcatctatgttcatctttcctttcctgtttaaattgtttgatatctattgatggtcatttaaaaacttaacactattaatatgtacttttttgatgtctttacttatggaattatggtaccttttgccaataatgagagggtctatactaaaatataaactttgcattgaatttataattctggtttttcttctaggtcatctaggagtacaagtacatctacttctcagtcttcaattaaagtactggagcttaaattcccggcctcctcttcactagtaggcagcccttctaggccatctagtgctagtagtagctctagtaatgttaagagcaaaaagagcagcaaataaacattttaatctcttctgaaaaagttgtaaacacaaaaacaaaaatatactttaaaatacaaaacgacccaacacattttatctagtggaaagtgtaaaaacttagtggtaagtgtaaaaactgatagttttaaaaaaaaaggaacgttctcattttctctactgttttcttcatactgaagaaattaatagcagattcttgacaaggctacatgttatacaagcataggaaaaatgctgtatttcactgtaattctgatgttcgtagtgttagaaaatagtttgcttcattatttcacgaaactacactcacttctaatgtaacaatctttcaagaagaaatttctaaagatttactgtactattatgagcgtattgcaatgtgaaaatctcatttaccctacaagacaccaaaattaggttttctttattcaaagtaactatttctcagacttttggggagaaaaattgttaaaggcagtttcttcttttgctataatttttaaccaaaaaatagcatcaacccctacccaccccacccccccaaaaaaaaaccggtaagagaaacactgtatatcaattttaaaatgcagcataaatttagaaaaatcacttctgaccttgaaataaatcacttctgaccttgaaataaacgcattaaagatttgctttcagatacagccaaccaagtataaacaattttgaaattttcttgatttaataaacgatttaatgaaagctaggtatgacttgatttgcaatagaaatttcatttacagttggaggtagactgccaaatgtagtagtttttccagttaacacttcattataacatgtgcccaacactttgtactcttggaatagagtgtggaatattataaaactggattttaaataaatgtattagaattcacgaatgtacatgtgtctccttcaaaccttgggaaaaaatgctcattacaactgtcattattttagaactgttgtttgtacttctttctgaaaagca

SEQ ID NO: 287443 - DNA, 456 bp, Homo sapiens
taaaataaaaatatatttccacattattttgtgagattcagagtataaaaatggccattcatagggctttatgttttttggatagcgtaagtttaacttcaggaataacttcttccctttgttttttataatagcaaagcttgactttaaaattgaattatgaaaaagatttggaataactataaacccttttcttaaaagaaaaaaaaaaactatgatcaattttaggcctagctaatatcttagtcaatggttaaattggaaaaaggtatattttcaagttttacttatatagcaataaaaaaaattttggttttgcaattaaaaataatttcaatatttgaccattttgttacgttgataggatttgatgatagaggacaatcttttaaaacttgaagttaagcgtactcgagaaatgcttcacagtaaggcagaagaagttctttccctaga

SEQ ID NO: 287444 - DNA, 562 bp, Homo sapiens
tgagctttggtggagagaaagaggaagaactgttgggagggaacatggaggcagaagatacggaataccctgtgtccatggagacttcagggcagacaaagagaagagtcaggaagccttttcttcactttacagcctatagacacctgtgatagtagttcattattgcaatgttcttccagagttcaaatggtatttttcagctcaagggaagttggagaagtgggtgtggtaggttccatgatatttattcccaggtaagacatcgctggaggagtggaagaggcagatgcaggagaacctggctcctggggagagctggccacggacaacatcatcctgacagtgccaaccacaaaccttcaggccctgaaggaccccgagcctgtgctccgcctctgggatgagatgatgcaggctgtggccaggctggcagctgagcccttccctttccgccgtcctgagaggattgtggctgatgtgcagatctcagctggtgggtgctcccagggaatcctccctgagcgtgcggatactagggactgacggacaggctctcagt

SEQ ID NO: 287445 - DNA, 694 bp, Homo sapiens
cgagaatgggaacttggaaaagagctgtctggcaaagttgagagttgatggtgcagccttcctacagattcctgcggagggggtccctgcttacatatccctgcacaggctcctgaggaagatgctacgagggtctggcctcccagctgtgagccaggaaaatccagttgccagtgactcctatgaggctgccgtgctctccctggccactgggctggctcactctggaactgactgctcccagctggcccaggggcttggcacctggacctgctcctccagtttgtacccctcaaaacaccccatcaccgtggagatcaatggaatcaacccaggcaacaatgattgctgggtgagtaccgggctctacctcctggaaggacaaaatgcagaagtctcactgtctgaagctgctgcctctgctggcctgagggtaaggtctgaacacccacatctgccacctctcaaaaccgtagagctgtgtcattctcatccactgtctagttccagctcatggcaatgctgccaggagtacagagatggattattctgcccattttacagattttacagatgaagcagctaaatttcagggcatctaagtgagtgactgaagtgcctagtgttatcaagcaagagaagctcactgcagaatggactagaagccaaaactatgacacttgagtttttcacc

SEQ ID NO: 287446 - DNA, 1518 bp, Homo sapiens
taaaacaaaagaaaacattttattgcaatttgattaacaaggagacaggagcccagctcaaatctgtcccattgtacttattttaaagagttattttagtagaaaaggtgtagggagtggattctgtgattagtaggtgattgacagaaagaaaaggaagggctggaaaatcctcgggcatgggcagttacctcttcatgcctcctcatgggtcccatgtgcaaactcagagggagttagtatgaaacatgcggtacaaatttaggctgtgtgtcagcaagctcattctgtacaaactctggttttatctctttatcttgacacctgaagggtgtgcataatcccatcactccccaaaatatgccctacatgcagaatttaaattcatcctgcctccttgactctgagggccacttcctaccacagctagggtcccttttctgtcagcattctttctggagcttgcttatatcaaacctaagaaaagcaactccaggactccagacaaaacagatctccacccatctggcggccagaaagggaagctctgggcaaagagggagagagaatcaacctcactcactctggatgggcctcctgtgtgttcacagaggacagagcagagtcccccagctcatcctcaatatcagcgtccccagactggcttaggtcctgctagaagaacccaggattttgcctggcagaaagacacaagacctttgccaggatcagcctggtctctcaccaattcatgtcaggtgaagacttatagtggagctgtttaaatccttagaaaaatgattttaaatgccttgaagtccaaatgactttggagtgctaaaatttcataagtttccatgcctagcacatagaaaagggaagctggggtttcatgggcatgtttgtctaataccttccatctacacaacctcacacgcacatcacaaagcatcacaaagactctaatttctccaacgcttggtggaatcacctgtccaggtacagattggctgccacaccgatgaccttaccaaggccaggaagctatctcgagcccccgtggtgactcaccaatgctggatggacaggactgagcggtcagtctcctgcctctggggcggcctcctctacgtcatcgtgcccaagggcagccaactaggccctgtgcctgtcactatcaggggagctgtgcctgccccatactacaagctgggtaagacatcgctggaggagtggaagaggcagatgcaggagaacctggctcctggggagagctggccacggacaacatcatcctgacagtgccaaccacaaaccttcaggccctgaaggaccccgagcctgtgctccgcctctgggatgagatgatgcaggctgtggccaggctggcagctgagcccttccctttccgccgtcctgagaggattgtggctgatgtgcagatctcagctggtgggtgctcccagggaatcctccctgagcgtgcggatactagggactgacggacaggctctcagt

SEQ ID NO: 287447 - DNA, 1331 bp, Homo sapiens
caaacccatgaggatccatgaggatgcaagttcaatccctggtcttgctcagtgggttaagcatcccttgttgctgtggctgtgtgtcagcaagctcattctgtacaaactctggttttatctctttatcttgacacctgaagggtgtgcataatcccatcactccccaaaatatgccctacatgcagaatttaaattcatcctgcctccttgactctgagggccacttcctaccacagctagggtcccttttctgtcagcattctttctggagcttgcttatatcaaacctaagaaaagcaactccaggactccagacaaaacagatctccacccatctggcggccagaaagggaagctctgggcaaagagggagagagaatcaacctcactcactctggatgggcctcctgtgtgttcacagaggacagagcagagtcccccagctcatcctcaatatcagcgtccccagactggcttaggtcctgctagaagaacccaggattttgcctggcagaaagacacaagacctttgccaggatcagcctggtctctcaccaattcatgtcaggtgaagacttatagtggagctgtttaaatccttagaaaaatgattttaaatgccttgaagtccaaatgactttggagtgctaaaatttcataagtttccatgcctagcacatagaaaagggaagctggggtttcatgggcatgtttgtctaataccttccatctacacaacctcacacgcacatcacaaagcatcacaaagactctaatttctccaacgcttggtggaatcacctgtccaggtacagattggctgccacaccgatgaccttaccaaggccaggaagctatctcgagcccccgtggtgactcaccaatgctggatggacaggactgagcggtcagtctcctgcctctggggcggcctcctctacgtcatcgtgcccaagggcagccaactaggccctgtgcctgtcactatcaggggagctgtgcctgccccatactacaagctgggtaagacatcgctggaggagtggaagaggcagatgcaggagaacctggctcctggggagagctggccacggacaacatcatcctgacagtgccaaccacaaaccttcaggccctgaaggaccccgagcctgtgctccgcctctgggatgagatgatgcaggctgtggccaggctggcagctgagcccttccctttccgccgtcctgagaggattgtggctgatgtgcagatctcagctggtgggtgctcccagggaatcctccctgagcgtgcggatactagggactgacggacaggctctcagt

SEQ ID NO: 287448 - DNA, 952 bp, Homo sapiens
cgagaatgggaacttggaaaagagctgtctggcaaagttgagagttgatggtgcagccttcctacagattcctgcggagggggtccctgcttacatatccctgcacaggctcctgaggaagatgctacgagggtctggcctcccagctgtgagccaggaaaatccagttgccagtgactcctatgaggctgccgtgctctccctggccactgggctggctcactctggaactgactgctcccagctggcccaggggcttggcacctggacctgctcctccagtttgtacccctcaaaacaccccatcaccgtggagatcaatggaatcaacccaggcaacaatgattgctgggtgagtaccgggctctacctcctggaaggacaaaatgcagaagtctcactgtctgaagctgctgcctctgctggcctgagggtacagattggctgccacaccgatgaccttaccaaggccaggaagctatctcgagcccccgtggtgactcaccaatgctggatggacaggactgagcggtcagtctcctgcctctggggcggcctcctctacgtcatcgtgcccaagggcagccaactaggccctgtgcctgtcactatcaggggagctgtgcctgccccatactacaagctgggtaagacatcgctggaggagtggaagaggcagatgcaggagaacctggctcctggggagagctggccacggacaacatcatcctgacagtgccaaccacaaaccttcaggccctgaaggaccccgagcctgtgctccgcctctgggatgagatgatgcaggctgtggccaggctggcagctgagcccttccctttccgccgtcctgagaggattgtggctgatgtgcagatctcagctggtgggtgctcccagggaatcctccctgagcgtgcggatactagggactgacggacaggctctcagt

SEQ ID NO: 287449 - DNA, 366 bp, Homo sapiens
ctacagattcctgcggagggggtccctgcttacatatccctgcacaggctcctgaggaagatgctacgagggtctggcctcccagctgtgagccaggaaaatccagttgccagtgactcctatgaggctgccgtgctctccctggccactgggctggctcactctggaactgactgctcccagctggcccaggggcttggcacctggacctgctcctccagtttgtacccctcaaaacaccccatcaccgtggagatcaatggaatcaacccaggtatgaaaacaggagagagtgcccagaacattaaagatgtaggggaaagtgggattggctgacactacacaggacattgcaggtacctaccc

SEQ ID NO: 287450 - DNA, 332 bp, Homo sapiens
cccacagctgtgtccggaagcagcaagcgtgcctgggcagagacccccagagtgtaaagaggtcctgggacaggctttgcacgttccacaagagtgtctcgctgtgtcgtctagactggagtgcagtggtgtgatcatggctcaactcctaggctcaagcgatcctcctgcctcagcctccggagtagctgctgggactgcaggaacgtgccaccatgcctggctcaaacacaaagttttttcataaaactcacttggcggcaaaattctaccttacctgaagttatttacggggtttttaatttccactttgaataaatattcacatcttg

SEQ ID NO: 287451 - DNA, 449 bp, Homo sapiens
cccacagctgtgtccggaagcagcaagcgtgcctgggcagagacccccagagtgtaaagaggtcctgggacaggctttgcacgttccacaagagtgtctcgctgtgtcgtctagactggagtgcagtggtgtgatcatggctcaactcctaggctcaagcgatcctcctgcctcagcctccggagtagctgctgggactgcaggaacgtgccaccatgcctggctcaaacacaaagttttttcataaaactcacttggcggcaaaattctaccttacctgaagttatttacggggtttttaatttccactttgaataaatattcacatcttgttgagtagtattatagtttcaggtaagggattaggaaaggagctgttaagtggaagggctctctcgggtggtttctgcaactgtggtcccagaggaagcactcacctcctgagcaac

SEQ ID NO: 287452 - DNA, 1021 bp, Homo sapiens
cccacagctgtgtccggaagcagcaagcgtgcctgggcagagacccccagagtgtaaagaggtcctgggacaggctttgcacgttccacaagagaccaaagaccaaagaggccaaagacctcaagcagggcctgtaggacccaaagtattggcaggtgccagagccactcctccccacatccaggtgagccctgtgccctggcaccaggatctgctgtctttgctaagtggaaggatctggtagtgccaaatagtgtttggaccttctaagctagctggtgtgggggtcaagtgcatggtctttggagctagacagcctttccacttaggacatatgtgaccttcaacaagtttctaaacctctctgggtttcagttttgccatctgtagaatggagctggtatctcccttacaggattaaaggaaataatgtgtgtcccatgctcagccctgcacctgccacagatcctgcaggacctcctcctttgccatatgctccttcagcagttctgtctgcacaatccccggccacagagacacacagctgaccccatggcgccgcagctcgtgggcacagtcagcagccagcttgtcacactgtggagaggcggaaggcagggagccccaaggtctcagctgcccacgctccccagtgtgatgcctactttagccaaccaagaggagcacaagcaaaggaactgtccatggatgaggcagaggaggagctgagaggagccagccttaccattctgaccactggggattgtacctcctgagctatagtgtctcgctgtgtcgtctagactggagtgcagtggtgtgatcatggctcaactcctaggctcaagcgatcctcctgcctcagcctccggagtagctgctgggactgcaggaacgtgccaccatgcctggctcaaacacaaagttttttcataaaactcacttggcggcaaaattctaccttacctgaagttatttacggggtttttaatttccactttgaataaatattcacatcttg

SEQ ID NO: 287453 - DNA, 1138 bp, Homo sapiens
cccacagctgtgtccggaagcagcaagcgtgcctgggcagagacccccagagtgtaaagaggtcctgggacaggctttgcacgttccacaagagaccaaagaccaaagaggccaaagacctcaagcagggcctgtaggacccaaagtattggcaggtgccagagccactcctccccacatccaggtgagccctgtgccctggcaccaggatctgctgtctttgctaagtggaaggatctggtagtgccaaatagtgtttggaccttctaagctagctggtgtgggggtcaagtgcatggtctttggagctagacagcctttccacttaggacatatgtgaccttcaacaagtttctaaacctctctgggtttcagttttgccatctgtagaatggagctggtatctcccttacaggattaaaggaaataatgtgtgtcccatgctcagccctgcacctgccacagatcctgcaggacctcctcctttgccatatgctccttcagcagttctgtctgcacaatccccggccacagagacacacagctgaccccatggcgccgcagctcgtgggcacagtcagcagccagcttgtcacactgtggagaggcggaaggcagggagccccaaggtctcagctgcccacgctccccagtgtgatgcctactttagccaaccaagaggagcacaagcaaaggaactgtccatggatgaggcagaggaggagctgagaggagccagccttaccattctgaccactggggattgtacctcctgagctatagtgtctcgctgtgtcgtctagactggagtgcagtggtgtgatcatggctcaactcctaggctcaagcgatcctcctgcctcagcctccggagtagctgctgggactgcaggaacgtgccaccatgcctggctcaaacacaaagttttttcataaaactcacttggcggcaaaattctaccttacctgaagttatttacggggtttttaatttccactttgaataaatattcacatcttgttgagtagtattatagtttcaggtaagggattaggaaaggagctgttaagtggaagggctctctcgggtggtttctgcaactgtggtcccagaggaagcactcacctcctgagcaac

SEQ ID NO: 287454 - DNA, 766 bp, Homo sapiens
cccacagctgtgtccggaagcagcaagcgtgcctgggcagagacccccagagtgtaaagaggtcctgggacaggctttgcacgttccacaagagaccaaagaccaaagaggccaaagacctcaagcagggcctgtaggacccaaagtattggcaggtgccagagccactcctccccacatccaggtgagccctgtgccctggcaccaggatctgctgtctttgctaagtggaaggatctggtagtgccaaatagtgtttggaccttctaagctagctggtgtgggggtcaagtgcatggtctttggagctagacagcctttccacttaggacatatgtgaccttcaacaagtttctaaacctctctgggtttcagttttgccatctgtagaatggagctggtatctcccttacaggattaaaggaaataatgtgtgtcccatgctcagccctgcacctgccacagtaagcacctggtgagtgggagtatctgatcttgttattgaggatgcagaggccgactcccctgttctctgcttccttcgccctccccttgccaacctgcttcaacacaggatcctgcaggacctcctcctttgccatatgctccttcagcagttctgtctgcacaatccccggccacagagacacacagctgaccccatggcgccgcagctcgtgggcacagtcagcagccagcttgtcacactgtggagaggcggaaggcagggtaagagccacctagccatgtcactttcctgccctgc

SEQ ID NO: 287455 - DNA, 581 bp, Homo sapiens
tgcctagctaattatttaaaaaatattttttgtagagactgggtctagctatgttgcccagactggtctccaactgctggcctcaagtgatcttgctgccttggccacccaaagtgctgggactacaggcatgagccactgtactccaccatggactgaatctttgaagagcagaaattagattttattagtcttggtaacttcagtggtttaccaatgcctagcaaatcatggatactcaaatatttatttaactgaagtctagtaaataagtaaaaaatgtgcagttcaataaagtcttgcctgaaatagaggaaagcacaggtccacaaccctttagttgcaattccaaaatctctgctctcaaacaaaaagttttttacttttctttcttttcttttttttaatacagtgtctcgctgtgtcgtctagactggagtgcagtggtgtgatcatggctcaactcctaggctcaagcgatcctcctgcctcagcctccggagtagctgctgggactgcaggaacgtgccaccatgcctggctcaaacacaaagttttttcataaaactcacttggcggca

SEQ ID NO: 287456 - DNA, 462 bp, Homo sapiens
cggccgcggcccctcggcagcatcgcggcccaggaaggcctggagcagctgctccgcctcagcactccccgcgcaacgctcccaggcgcccgcagccggccgcaggctcatggccacgtaggtccccaggagtcgcagtcgtcggtcggcgccgggttccccatccgcgttctccgccgcgagcgcggcccgctcctccgcgagccgcatcgcgcgcggcctccagctgcatcggtttccctagcgacggggacgcggccaggactcactcctctgctcccttcctattgggcacggacccctggtcccgccccttccaggctaataagtacctacaggggtggagacaggatggcaacgtgatgttgttattgttgttttctgcaaagaagggttgtggaaaaacaagatggagaaggtgagaaaatgaaagtggaagatctggaatatctgggtcaatgg

SEQ ID NO: 287457 - DNA, 377 bp, Homo sapiens
tggcttcttgtgattggccagaacttttcctcactggagagatgaggagaatccagtcctccaaccagctgagagaaaacactgcagtagcagagatagcaatggctgttccaccccacactgatacgatgtcagggagccaggggtgggctcaacaggctgaatgatgccagggactcccaagggtctatacatttaaccctggaggaagtggcctctgaccaggcagtgtttcaagaacccagctccattcatcctatgatgccaccatcctcagcatttgacttccatggctcctgtaagagaagagaacatgaagaacaaaacaggaggtttttatgggagatatgctgccaagagaatttttttctttaaga

SEQ ID NO: 287458 - DNA, 685 bp, Homo sapiens
gatacatttttattctttattaatatcatttgaggtcttcaacagttttgtttcaatgtgaagtcttctctgcaaaaaagacttctgagatattgaaatataatctgggctatgaaaaagccacttttctgatatgaactcagattccccagggttttttgtgctaacaggccatggcaggggatggtggtaaatggtggtgatttcgccttctccactctcacttttagctaacaaaattctttgccttgaaagctttattaaaccattcattttacccaaagataaaatgttagaggaatagtctgtctttttctttgaggcttcctttcctgagccattccatatttcagcattgttttgtgtcttccgttgtatcttttcctcggcagatatgcaaataatgggtttctttttcccttttccaggagcacattttgatttatctgaaattgtctgaggtgccaagtccattcttctagccctgtgtaatttatctgcattcatgcacattgcagagctcactgtattagatcttttagctaaacagctagacatttattttctcacagttctgagagactgagtttatgagatcagggtcgccagcagtggttaagtttctggtcaggtctctcttcccagcgtgcagacagctccactcctgtctgtgtggtcacctaag

SEQ ID NO: 287459 - DNA, 657 bp, Homo sapiens
cgtgtggtgtggtggcgcgcaggccacatgggatggaatgatgaggtacgaccccagcgccgcccgcccagctccgccgcaccttcgtcctgccttctgggactgacccccagctctggccacaaggacagcgcccctcccaccccagctgctctggccccggccctagaaggagcacattttgatttatctgaaattgtctgaggtgccaagtccattcttctagccctgtgtaatttatctgcattcatgcacattgcagagctcactgtattagaactctgagcactgtggtagtttaatttaaccaagtgctcccataatgagaagccattcctagaaccctcagaatgttgctggctcataccttgaggccaatatctccggctccggatccactcaatttctctcagaaggctgcaaaagatcaaaagttgtcaagaggtcatatatatagcatgaataaccagaagcatatttctgtttggaacatgaaacagaaactcactgcaggattccatggattccatggattgatgaatgagaagatcccaggtggatcacccttaaatcaactgatctgtataaatagcctactgcctcaatcatgacgtgatgacaagagtcacttgccaataaatgacctgctagatattt

SEQ ID NO: 287460 - DNA, 337 bp, Homo sapiens
gcggccgcgggcaccgggagagcagcgcgccgcggcccctcgcctccctcagagcgctccgcaccgccgtccccaccgaccttcaacggggccggggccaggctccgaccgccagcagtcggctcctccgtgcagtcccgggtagagagcccggtccctgcgctagtcgatttgtgcagtaggaaaggaggctgcaggggatctgcgccggggcaggacagatgcctttcgggacccagtgtttgcatcttgggagatgtgggtgctgatctggttgtttcttggtttatgacgccaaaaagggcgggagggggctgatgaagtgaagcctttcgct

SEQ ID NO: 287461 - DNA, 873 bp, Homo sapiens
gagggccgcagctagagtcggcgccacgagggggccgagcagggtgcggcggcggcggggcgctccggggaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtatgaaggactctgcagacaaccttgctctaaagcttccttcatctctgtcccctcttgggcctgaggctgccacgagccagactgcaaccctgagcctcactgctcttctctgaaattggtccccaggtcctacaacgagtcctgccctcctgaccctgctgagcaagggggtcccaagacctgctgcaccctggacgatgtccccctcatcaggtcacacagctaataagcggaggcacctggatttaagctggagccctcagattgcccagcccgtgttctggctcaaggatagccaaaccagccgcagggctcagcaaagagtgtcagggttgcccgaacactcctgggcactcccttctctctcacacacatgagctctgctttgggggcccagcctggaaccagttgttcatgagggaccctggatcttcacataaatcagtggcctgcctgctaaggagcaggtgcagcaagtgtggctcctatcccccagaaagctgcctcttcagcctcattggcaacatgggtgctttcatgggtgagttgtacccttagccctgaccctg

SEQ ID NO: 287462 - DNA, 1533 bp, Homo sapiens
gagggccgcagctagagtcggcgccacgagggggccgagcagggtgcggcggcggcggggcgctccggggaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtcctacaacgagtcctgccctcctgaccctgctgagcaagggggtcccaagacctgctgcaccctggacgatgtccccctcatcagcaagtgtggctcctatcccccagaaagctgcctcttcagcctcattggcaacatgggtgctttcatggtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaagaattctaatttgca

SEQ ID NO: 287463 - DNA, 2075 bp, Homo sapiens
gagggccgcagctagagtcggcgccacgagggggccgagcagggtgcggcggcggcggggcgctccggggaggtgcgtactgggctccttcccttcctccgggcttccaggaatcacctggggactctcgcgtcccgggtcctggggggtcgccggccgcagggtccggccccagccggggtccccgcgcccaggcgagcgggggccgggccgggctgggctttccgcgtgaacccgcccctcgcccagggcgccgatggtcaggtggttgcctgcgcgccgccgactcgccaccgctccactgggccggcacccagcctctccttggcgtggcctcttcggttgtccagcccttctcccagccctggtccctcagaaggagggtaactcccttccagatgttacggtccgcctgcgtctctcagcacgccggtggcatttgggttgaccgcggaggcccccagtgccagagggtgttcacgttctgccgtgggctcagcccaaactttggacgctcagagacccaacgggagcgctggataaggtgttgacccccttcccctcccccttcccggccagttacccactcctggactttgatctctctccaccaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtcctacaacgagtcctgccctcctgaccctgctgagcaagggggtcccaagacctgctgcaccctggacgatgtccccctcatcagcaagtgtggctcctatcccccagaaagctgcctcttcagcctcattggcaacatgggtgctttcatggtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaagaattctaatttgca

SEQ ID NO: 287464 - DNA, 2402 bp, Homo sapiens
gagggccgcagctagagtcggcgccacgagggggccgagcagggtgcggcggcggcggggcgctccggggaggtgcgtactgggctccttcccttcctccgggcttccaggaatcacctggggactctcgcgtcccgggtcctggggggtcgccggccgcagggtccggccccagccggggtccccgcgcccaggcgagcgggggccgggccgggctgggctttccgcgtgaacccgcccctcgcccagggcgccgatggtcaggtggttgcctgcgcgccgccgactcgccaccgctccactgggccggcacccagcctctccttggcgtggcctcttcggttgtccagcccttctcccagccctggtccctcagaaggagggtaactcccttccagatgttacggtccgcctgcgtctctcagcacgccggtggcatttgggttgaccgcggaggcccccagtgccagagggtgttcacgttctgccgtgggctcagcccaaactttggacgctcagagacccaacgggagcgctggataaggtgttgacccccttcccctcccccttcccggccagttacccactcctggactttgatctctctccaccaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtatgaaggactctgcagacaaccttgctctaaagcttccttcatctctgtcccctcttgggcctgaggctgccacgagccagactgcaaccctgagcctcactgctcttctctgaaattggtccccaggcatggcttcttgccacctacccacttcccactatccctttgcccctttggttactgcttcaggcgggcactggggagtgggatcttctgtccctgtaggggaggtctgggagagagtcctctttgaggcctgaggctataggccaagggcctgggggcagtcccttcccccagtctactccctgtcctgcctgccaggtcctacaacgagtcctgccctcctgaccctgctgagcaagggggtcccaagacctgctgcaccctggacgatgtccccctcatcagcaagtgtggctcctatcccccagaaagctgcctcttcagcctcattggcaacatgggtgctttcatggtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaagaattctaatttgca

SEQ ID NO: 287465 - DNA, 1844 bp, Homo sapiens
gagggccgcagctagagtcggcgccacgagggggccgagcagggtgcggcggcggcggggcgctccggggaggtgcgtactgggctccttcccttcctccgggcttccaggaatcacctggggactctcgcgtcccgggtcctggggggtcgccggccgcagggtccggccccagccggggtccccgcgcccaggcgagcgggggccgggccgggctgggctttccgcgtgaacccgcccctcgcccagggcgccgatggtcaggtggttgcctgcgcgccgccgactcgccaccgctccactgggccggcacccagcctctccttggcgtggcctcttcggttgtccagcccttctcccagccctggtccctcagaaggagggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtcctacaacgagtcctgccctcctgaccctgctgagcaagggggtcccaagacctgctgcaccctggacgatgtccccctcatcagcaagtgtggctcctatcccccagaaagctgcctcttcagcctcattggcaacatgggtgctttcatggtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaagaattctaatttgca

SEQ ID NO: 287466 - DNA, 2530 bp, Homo sapiens
gagggccgcagctagagtcggcgccacgagggggccgagcagggtgcggcggcggcggggcgctccggggaggtgcgtactgggctccttcccttcctccgggcttccaggaatcacctggggactctcgcgtcccgggtcctggggggtcgccggccgcagggtccggccccagccggggtccccgcgcccaggcgagcgggggccgggccgggctgggctttccgcgtgaacccgcccctcgcccagggcgccgatggtcaggtggttgcctgcgcgccgccgactcgccaccgctccactgggccggcacccagcctctccttggcgtggcctcttcggttgtccagcccttctcccagccctggtccctcagaaggagggtaactcccttccagatgttacggtccgcctgcgtctctcagcacgccggtggcatttgggttgaccgcggaggcccccagtgccagagggtgttcacgttctgccgtgggctcagcccaaactttggacgctcagagacccaacgggagcgctggataaggtgttgacccccttcccctcccccttcccggccagttacccactcctggactttgatctctctccaccaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtgagtaaaggggggtgcccggggggcaacaggagcttgatgacgcacacaaagtctcttgtcctgtcatagccacggtggtacccagggtcactctgggtgtctcaaaagcctgacttggtgcctgggcacacagccccttgggacaagctggcaccactgctgtccagcagggtggccctgacaaatatacttctagccagggcaatttccagagggcctgtagctgggggcatgctgcaggtgctggtgtggcatcaagccttagggacctcaacttgagtccccagcaacaataatgaggctgaatggggccagaaatcaaggtatgccatggctgtgatgaaccaccatgtatgccctgtggagaactggtatgaaggactctgcagacaaccttgctctaaagcttccttcatctctgtcccctcttgggcctgaggctgccacgagccagactgcaaccctgagcctcactgctcttctctgaaattggtccccaggtcctacaacgagtcctgccctcctgaccctgctgagcaagggggtcccaagacctgctgcaccctggacgatgtccccctcatcagcaagtgtggctcctatcccccagaaagctgcctcttcagcctcattggcaacatgggtgctttcatggtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaagaattctaatttgca

SEQ ID NO: 287467 - DNA, 1860 bp, Homo sapiens
gagggccgcagctagagtcggcgccacgagggggccgagcagggtgcggcggcggcggggcgctccggggaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtatgaaggactctgcagacaaccttgctctaaagcttccttcatctctgtcccctcttgggcctgaggctgccacgagccagactgcaaccctgagcctcactgctcttctctgaaattggtccccaggcatggcttcttgccacctacccacttcccactatccctttgcccctttggttactgcttcaggcgggcactggggagtgggatcttctgtccctgtaggggaggtctgggagagagtcctctttgaggcctgaggctataggccaagggcctgggggcagtcccttcccccagtctactccctgtcctgcctgccaggtcctacaacgagtcctgccctcctgaccctgctgagcaagggggtcccaagacctgctgcaccctggacgatgtccccctcatcagcaagtgtggctcctatcccccagaaagctgcctcttcagcctcattggcaacatgggtgctttcatggtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaagaattctaatttgca

SEQ ID NO: 287468 - DNA, 2183 bp, Homo sapiens
gagggccgcagctagagtcggcgccacgagggggccgagcagggtgcggcggcggcggggcgctccggggaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtatgaaggactctgcagacaaccttgctctaaagcttccttcatctctgtcccctcttgggcctgaggctgccacgagccagactgcaaccctgagcctcactgctcttctctgaaattggtccccaggtcctacaacgagtcctgccctcctgaccctgctgagcaagggggtcccaagacctgctgcaccctggacgatgtccccctcatcaggtaaggcctggacattgggccggtcagggagatctaagggcctcccagacagcccctcaagcaaagagctgtccttgggtctcaggaacaataagtatcctaagagccacttaataacaacactacttgacagttactgtggggcaggcactctgctgagtgctttatatgcattgtctcttttcatcctcccaggagtgaggcaggtattgttttcaccattttataggtgaggaaacaggctcagtcttcctcatccaggtcacacagctaataagcggaggcacctggatttaagctggagccctcagattgcccagcccgtgttctggctcaaggatagccaaaccagccgcagggctcagcaaagagtgtcagggttgcccgaacactcctgggcactcccttctctctcacacacatgagctctgctttgggggcccagcctggaaccagttgttcatgagggaccctggatcttcacataaatcagtggcctgcctgctaaggagcaggtgcagcaagtgtggctcctatcccccagaaagctgcctcttcagcctcattggcaacatgggtgctttcatggtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaagaattctaatttgca

SEQ ID NO: 287469 - DNA, 1982 bp, Homo sapiens
cttggatttcttaagaaacagccaagtctttgtgtctgcttctctggacccaccgcagccctggccagaggcaggcatggggcgccacgttgagagagcttcctagaggactcaccgttggccggtgcaggctgcaaaatgtgcgcagtggcggagagacgctcctccagccatgtgcacggcgacaatcccaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtatgaaggactctgcagacaaccttgctctaaagcttccttcatctctgtcccctcttgggcctgaggctgccacgagccagactgcaaccctgagcctcactgctcttctctgaaattggtccccaggcatggcttcttgccacctacccacttcccactatccctttgcccctttggttactgcttcaggcgggcactggggagtgggatcttctgtccctgtaggggaggtctgggagagagtcctctttgaggcctgaggctataggccaagggcctgggggcagtcccttcccccagtctactccctgtcctgcctgccaggtcctacaacgagtcctgccctcctgaccctgctgagcaagggggtcccaagacctgctgcaccctggacgatgtccccctcatcagcaagtgtggctcctatcccccagaaagctgcctcttcagcctcattggcaacatgggtgctttcatggtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaagaattctaatttgca

SEQ ID NO: 287470 - DNA, 1465 bp, Homo sapiens
gagggccgcagctagagtcggcgccacgagggggccgagcagggtgcggcggcggcggggcgctccggggaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtcctacaacgagtcctgccctcctgaccctgctgagcaagggggtcccaagacctgctgcaccctggacgatgtccccctcatcagtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaagaattctaatttgca

SEQ ID NO: 287471 - DNA, 1654 bp, Homo sapiens
tggtaccggtcggagtctataggataccaccaccctggctcccctccctcatgaccgcctggatcctcctgcctgtcagcctgtcagcgttctccatcactggcatatggactgtgtatgccatggctgtgatgaaccaccatgtatgccctgtggagaactggtatgaaggactctgcagacaaccttgctctaaagcttccttcatctctgtcccctcttgggcctgaggctgccacgagccagactgcaaccctgagcctcactgctcttctctgaaattggtccccaggcatggcttcttgccacctacccacttcccactatccctttgcccctttggttactgcttcaggcgggcactggggagtgggatcttctgtccctgtaggggaggtctgggagagagtcctctttgaggcctgaggctataggccaagggcctgggggcagtcccttcccccagtctactccctgtcctgcctgccaggtcctacaacgagtcctgccctcctgaccctgctgagcaagggggtcccaagacctgctgcaccctggacgatgtccccctcatcagtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaagaattctaatttgca

SEQ ID NO: 287472 - DNA, 1897 bp, Homo sapiens
gagggccgcagctagagtcggcgccacgagggggccgagcagggtgcggcggcggcggggcgctccggggaggtgcgtactgggctccttcccttcctccgggcttccaggaatcacctggggactctcgcgtcccgggtcctggggggtcgccggccgcagggtccggccccagccggggtccccgcgcccaggcgagcgggggccgggccgggctgggctttccgcgtgaacccgcccctcgcccagggcgccgatggtcaggtggttgcctgcgcgccgccgactcgccaccgctccactgggccggcacccagcctctccttggcgtggcctcttcggttgtccagcccttctcccagccctggtccctcagaaggagggtaactcccttccagatgttacggtccgcctgcgtctctcagcacgccggtggcatttgggttgaccgcggaggcccccagtgccagagggtgttcacgttctgccgtgggctcagcccaaactttggacgctcagagacccaacgggagcgctggataaggtgttgacccccttcccctcccccttcccggccagttacccactcctggactttgatctctctccaccaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtcctacaacgagtcctgccctcctgaccctgctgagcaagggggtcccaagacctgctgcaccctggacgatgtccccctcatcagcaagtgtggctcctatcccccagaaagctgcctcttcagcctcattggcaacatgggtgctttcatggtggccctgatctgcctcctgcgctacgggcagctcctggagcagagtcggcactcttgggttaacaccacggcactcatcacaggctgcaccaacgctgcgggcctcttggtggttggcaactttcaggtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaagaattctaatttgca

SEQ ID NO: 287473 - DNA, 1096 bp, Homo sapiens
gagggccgcagctagagtcggcgccacgagggggccgagcagggtgcggcggcggcggggcgctccggggaggccaggacagctgatggttgtggcagaaacatctcaaggtcctacaacgagtcctgccctcctgaccctgctgagcaagggggtcccaagacctgctgcaccctggacgatgtccccctcatcagtggccctgatctgcctcctgcgctacgggcagctcctggagcagagtcggcactcttgggttaacaccacggcactcatcacaggctgcaccaacgctgcgggcctcttggtggttggcaactttcaggtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaagaattctaatttgca

SEQ ID NO: 287474 - DNA, 1943 bp, Homo sapiens
gagggccgcagctagagtcggcgccacgagggggccgagcagggtgcggcggcggcggggcgctccggggaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtcctacaacgagtcctgccctcctgaccctgctgagcaagggggtcccaagacctgctgcaccctggacgatgtccccctcatcagcaagtgtggctcctatcccccagaaagctgcctcttcagcctcattggcaacatgggtgctttcatggtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaagaattctaatttgcatgtttgtagcctgttctggagagttggggggcctgatctgggatggctttccataagccaaggatgggaggaagcccttgccccccaggagtgctgagtgcactctgttgccagaaacaaaggatgccaggtgccacccaaataccccttcaaagggcttgaaacccttctgggcctctaagcaatctaaagaactaacttggtctgataatctcacccatcccccactcagagtctggtttgaactttgattccttaggaggcatggggggaaggtgggggtggtacagagagcaactttaaaatattaaaagtggctttctcaatggagcaaaaagaaaacctgtgggattacaaagttaactagacattgcagtgggaggagggtgcaggctagtttatcagctttt

SEQ ID NO: 287475 - DNA, 424 bp, Homo sapiens
gtgttgccaggtttccgtatgtcctactgaacatttccttagcctcgttgtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtgg

SEQ ID NO: 287476 - DNA, 662 bp, Homo sapiens
gcaacagctgtttgttattgtagtcgtcaaggacagaaaaaggacaaggctgccagaagatgttgcatatggaacagaagattcttgccctggaagaaggaatagaggagatgtaaatatcccttctttcttgggggaaggaaatagatgaactgtatgctaagttagagcctctctttatctataaatgatctgttggttaaacaggatacctcccttctgaacatctcagcaccccatcaagagaacttcaggtctctgccatttagacgtgtcatttgtaagtaaaataaatcagggaagtaataggaggaaagctaagaatgaaaggaattcatcaccactgcaaatttgtccctgaagcaagaaagaaacttaactgtttcaaccaactgccaatcagaacacctttgaattcaactatcagctgtaagcccaacaccctccttgaagttgtcctacctttctggaccaaatgaacatatacgttacatacactgattgatgtctgcctataaattctgtccccctaaactgtgtaaaatcaagctgtaacccaaccactgtgtttggatacatgttctcaggacctcctgaggctatgtcatgggtcatggtcctcacatttggctcagaataaatgtctttaaatattttacaga

SEQ ID NO: 287477 - DNA, 433 bp, Homo sapiens
gcaacagctgtttgttattgtagtcgtcaaggacagaaaaaggacaaggctgccagaagatgttgcatatggaacagaagattcttgccctggaagaaggaatagaggagatgtaaatatcccttctttcttgggggaaggaaatagatgaactgtatgctaagttagagcctctctttatctataaatgatctgttggttaaacaggatacctcccttctgaacatctcagcaccccatcaagagaacttcaggtctctgccatttagacgtgtcatttgtaagtaaaataaatcagggaagtaataggaggaaagctaagaatgaaaggaattcatcaccactgcaaatttgtccctgaagcaaggtgagtccctgcccatctggctacaccagctcttttttttttttttttttttttttttttttggcc

SEQ ID NO: 287478 - DNA, 2204 bp, Homo sapiens
gcggccgccgccatcttcgcgcgcccgctcgccctaaccccgcccccagacgccatgcccacgtgaccgctcgcccccggacccggagcgtgggcggggatttcgtcacgtgacgttgccgcggggcggtgccaagatggcgaggcccaaagaggtgaggagccggcagcgggggcggctgtaactgtgaggaaggctgcagagtggcgacgtctacgccgtaggttggaggctgtggggggtggccgggcgccagctcccaggccgcagaagtgacctgcggtggagttccctcctcgctgctggagaacggagggagaaggttgctggccgggtgaaagtgcctccctctgcttgacggggctgaggggcccgaagtctagggcgtccgtagtcgccccggcctccgtgaagccccaggtctagagatatgacccgagagtgcccatctccggccccggggcctggggctccgctgagtggatcggtgctggcagaggcggcagtagtgtttgcagtggtgctgagcatccacgcaaccgtatgggaccgatactcgtggtgcgccgtggccctcgcagtgcaggccttctacgtccaatacaagtgggaccggctgctacagcagggaagcgccgtcttccagttccgaatgtccgcaaacagtggcctattgcccgcctccatggtcatgcctttgcttggactagtcatgaaggagcggtgccagactgctgggaacccgttctttgagcgttttggcattgtggtggcagccactggcatggcagtggccctcttctcatcagtgttggcgctcggcatcactcgcccagtgccaaccaacacttgtgtcatcttgggcttggctggaggtgttatcatttatatcatgaagcactcgttgagcgtgggggaggtgatcgaagtcctggaagtccttctgatcttcgtttatctcaacatgatcctgctgtacctgctgccccgctgcttcacccctggtgaggcactgctggtattgggtggcattagctttgtcctcaaccagctcatcaagcgctctctgacactggtggaaagtcagggggacccagtggacttcttcctgctggtggtggtagtagggatggtactcatgggcattttcttcagcactctgtttgtcttcatggactcaggcacctgggcctcctccatcttcttccacctcatgacctgtgtgctgagccttggtgtggtcctaccctggctgcaccggctcatccgcaggaatcccctgctctggcttcttcagtttctcttccagacagacacccgcatctacctcctagcctattggtctctgctggccaccttggcctgcctggtggtgctgtaccagaatgccaagcggtcatcttccgagtccaagaagcaccaggcccccaccatcgcccgaaagtatttccacctcattgtggtagccacctacatcccaggtatcatctttgaccggccactgctctatgtagccgccactgtatgcctggcggtcttcatcttcctggagtatgtgcgctacttccgcatcaagcctttgggtcacactctacggagcttcctgtccctttttctggatgaacgagacagtggaccactcattctgacacacatctacctgctcctgggcatgtctcttcccatctggctgatccccagaccctgcacacagaagggtagcctgggaggagccagggccctcgtcccctatgccggtgtcctggctgtgggtgtgggtgatactgtggcctccatcttcggtagcaccatgggggagatccgctggcctggaaccaaaaagacttttgaggggaccatgacatctatatttgcgcagatcatttctgtagctctgatcttaatctttgacagtggagtggacctaaactacagttatgcttggattttggggtccatcagcactgtgtccctcctggaagcatacactacacagatagacaatctccttctgcctctctacctcctgatattgctgatggcctagctgttacagtgcagcagcagtgacggaggaaacagacatggggagggtgaacagtccccacagcagacagctacttgggcatgaagagccaaggtgtgaaaagcagatttgatttttcagttgattcagatttaaaataaaaagcaaagctctccta

SEQ ID NO: 287479 - DNA, 2847 bp, Homo sapiens
gcggccgccgccatcttcgcgcgcccgctcgccctaaccccgcccccagacgccatgcccacgtgaccgctcgcccccggacccggagcgtgggcggggatttcgtcacgtgacgttgccgcggggcggtgccaagatggcgaggcccaaagaggtgaggagccggcagcgggggcggctgtaactgtgaggaaggctgcagagtggcgacgtctacgccgtaggttggaggctgtggggggtggccgggcgccagctcccaggccgcagaagtgacctgcggtggagttccctcctcgctgctggagaacggagggagaaggttgctggccgggtgaaagtgcctccctctgcttgacggggctgaggggcccgaagtctagggcgtccgtagtcgccccggcctccgtgaagccccaggtctagagatatgacccgagagtgcccatctccggccccggggcctggggctccgctgagtggatcggtgctggcagaggcggcagtagtgtttgcagtggtgctgagcatccacgcaaccgtatgggaccgatactcgtggtgcgccgtggccctcgcagtgcaggccttctacgtccaatacaagtgggaccggctgctacagcagggaagcgccgtcttccagttccgaatgtccgcaaacagtggcctattgcccgcctccatggtcatgcctttgcttggactagtcatgaaggagcggtgccagactgctgggaacccgttctttgagcgttttggcattgtggtggcagccactggcatggcagtggccctcttctcatcagtgttggcgctcggcatcactcgcccagtgccaaccaacacttgtgtcatcttgggcttggctggaggtgttatcatttatatcatgaagcactcgttgagcgtgggggaggtgatcgaagtcctggaagtccttctgatcttcgtttatctcaacatgatcctgctgtacctgctgccccgctgcttcacccctggtgaggcactgctggtattgggtggcattagctttgtcctcaaccagctcatcaagcgctctctgacactggtggaaagtcagggggacccagtggacttcttcctgctggtggtggtagtagggatggtactcatgggcattttcttcagcactctgtttgtcttcatggactcaggcacctgggcctcctccatcttcttccacctcatgacctgtgtgctgagccttggtgtggtcctaccctggctgcaccggctcatccgcaggaatcccctgctctggcttcttcagtttctcttccagacagacacccgcatctacctcctagcctattggtctctgctggccaccttggcctgcctggtggtgctgtaccagaatgccaagcggtcatcttccgagtccaagaagcaccaggcccccaccatcgcccgaaagtatttccacctcattgtggtagccacctacatcccaggtatcatctttgaccggccactgctctatgtagccgccactgtatgcctggcggtcttcatcttcctggagtatgtgcgctacttccgcatcaagcctttgggtcacactctacggagcttcctgtccctttttctggatgaacgagacagtggaccactcattctgacacacatctacctgctcctgggcatgtctcttcccatctggctgatccccagaccctgcacacagaagggtagcctgggaggagccagggccctcgtcccctatgccggtgtcctggctgtgggtgtgggtgatactgtggcctccatcttcggtagcaccatgggggagatccgctggcctggaaccaaaaagacttttgaggggaccatgacatctatatttgcgcagatcatttctgtagctctgatcttaatctttgacagtggagtggacctaaactacagttatgcttggattttggggtccatcagcactgtgtccctcctggaagcatacactacacagatagacaatctccttctgcctctctacctcctgatattgctgatggcctagctgttacagtgcagcagcagtgacggaggaaacagacatggggagggtgaacagtccccacagcagacagctacttgggcatgaagagccaaggtgtgaaaagcagatttgatttttcagttgattcagatttaaaataaaaagcaaagctctcctaaaaaaaaaaaaaaaaaaaaaaaaaaaaaaaaaaaaaaaaaaaaaaacaacaaaaaaaaaaaacaaaaaaaaaaaacaaaaaaaacagagaaacgcaagcaacgacggcaacacacgacgagacgacagaagcgacaaagcgagcaacggcacaagcaacgacaaagaggcgggggcagcggccgcaacacgcagcaacggcgcagcagacagcgaagcgtgcagcactgccagctcacagtgaccgtataagcaggaagacagcagacaacagagcaagcggggaagacaacagaacaagggggcaaaaccgcaaacacacagcatcgaagaaacacaccacgcgaccgcggagatacagcgcgcgccgcaagcacgcgaagccgtcggcagtaaccagcagaacaagacaggcggctggcggtggggacgcgcgaggacgggggagaacgaccgagcaccggacgaccacgcaccagcagggcggagaaaagacgggaggcagagagcggcgcgactgcggaggggagcgagacgggcgcggcgcagcgaggcgcagcgcagagagccaaggaggagccagcggacgccacgggggcagcaaggcggccaagagcgcagcggggagaccagacagcaacagg

SEQ ID NO: 287480 - DNA, 2745 bp, Homo sapiens
aacctagtgctaagtacgaggcccgggtgtaatcggccgagggcccaaagaggtgaggagccggcagcgggggcggctgtaactgtgaggaaggctgcagagtggcgacgtctacgccgtaggttggaggctgtggggggtggccgggcgccagctcccaggccgcagaagtgacctgcggtggagttccctcctcgctgctggagaacggagggagaaggttgctggccgggtgaaagtgcctccctctgcttgacggggctgaggggcccgaagtctagggcgtccgtagtcgccccggcctccgtgaagccccaggtctagagatatgacccgagagtgcccatctccggccccggggcctggggctccgctgagtggatcggtgctggcagaggcggcagtagtgtttgcagtggtgctgagcatccacgcaaccgtatgggaccgatactcgtggtgcgccgtggccctcgcagtgcaggccttctacgtccaatacaagtgggaccggctgctacagcagggaagcgccgtcttccagttccgaatgtccgcaaacagtggcctattgcccgcctccatggtcatgcctttgcttggactagtcatgaaggagcggtgccagactgctgggaacccgttctttgagcgttttggcattgtggtggcagccactggcatggcagtggccctcttctcatcagtgttggcgctcggcatcactcgcccagtgccaaccaacacttgtgtcatcttgggcttggctggaggtgttatcatttatatcatgaagcactcgttgagcgtgggggaggtgatcgaagtcctggaagtccttctgatcttcgtttatctcaacatgatcctgctgtacctgctgccccgctgcttcacccctggtgaggcactgctggtattgggtggcattagctttgtcctcaaccagctcatcaagcgctctctgacactggtggaaagtcagggggacccagtggacttcttcctgctggtggtggtagtagggatggtactcatgggcattttcttcagcactctgtttgtcttcatggactcaggcacctgggcctcctccatcttcttccacctcatgacctgtgtgctgagccttggtgtggtcctaccctggctgcaccggctcatccgcaggaatcccctgctctggcttcttcagtttctcttccagacagacacccgcatctacctcctagcctattggtctctgctggccaccttggcctgcctggtggtgctgtaccagaatgccaagcggtcatcttccgagtccaagaagcaccaggcccccaccatcgcccgaaagtatttccacctcattgtggtagccacctacatcccaggtatcatctttgaccggccactgctctatgtagccgccactgtatgcctggcggtcttcatcttcctggagtatgtgcgctacttccgcatcaagcctttgggtcacactctacggagcttcctgtccctttttctggatgaacgagacagtggaccactcattctgacacacatctacctgctcctgggcatgtctcttcccatctggctgatccccagaccctgcacacagaagggtagcctgggaggagccagggccctcgtcccctatgccggtgtcctggctgtgggtgtgggtgatactgtggcctccatcttcggtagcaccatgggggagatccgctggcctggaaccaaaaagacttttgaggggaccatgacatctatatttgcgcagatcatttctgtagctctgatcttaatctttgacagtggagtggacctaaactacagttatgcttggattttggggtccatcagcactgtgtccctcctggaagcatacactacacagatagacaatctccttctgcctctctacctcctgatattgctgatggcctagctgttacagtgcagcagcagtgacggaggaaacagacatggggagggtgaacagtccccacagcagacagctacttgggcatgaagagccaaggtgtgaaaagcagatttgatttttcagttgattcagatttaaaataaaaagcaaagctctcctaaaaaaaaaaaaaaaaaaaaaaaaaaaaaaaaaaaaaaaaaaaaaaacaacaaaaaaaaaaaacaaaaaaaaaaaacaaaaaaaacagagaaacgcaagcaacgacggcaacacacgacgagacgacagaagcgacaaagcgagcaacggcacaagcaacgacaaagaggcgggggcagcggccgcaacacgcagcaacggcgcagcagacagcgaagcgtgcagcactgccagctcacagtgaccgtataagcaggaagacagcagacaacagagcaagcggggaagacaacagaacaagggggcaaaaccgcaaacacacagcatcgaagaaacacaccacgcgaccgcggagatacagcgcgcgccgcaagcacgcgaagccgtcggcagtaaccagcagaacaagacaggcggctggcggtggggacgcgcgaggacgggggagaacgaccgagcaccggacgaccacgcaccagcagggcggagaaaagacgggaggcagagagcggcgcgactgcggaggggagcgagacgggcgcggcgcagcgaggcgcagcgcagagagccaaggaggagccagcggacgccacgggggcagcaaggcggccaagagcgcagcggggagaccagacagcaacagg

SEQ ID NO: 287481 - DNA, 1435 bp, Homo sapiens
gcggccgccgccatcttcgcgcgcccgctcgccctaaccccgcccccagacgccatgcccacgtgaccgctcgcccccggacccggagcgtgggcggggatttcgtcacgtgacgttgccgcggggcggtgccaagatggcgaggcccaaagaggtgaggagccggcagcgggggcggctgtaactgtgaggaaggctgcagagtggcgacgtctacgccgtaggttggaggctgtggggggtggccgggcgccagctcccaggccgcagaagtgacctgcggtggagttccctcctcgctgctggagaacggagggagaaggttgctggccgggtgaaagtgcctccctctgcttgacggggctgaggggcccgaagtctagggcgtccgtagtcgccccggcctccgtgaagccccaggtctagagatatgacccgagagtgcccatctccggccccggggcctggggctccgctgagtggatcggtgctggcagaggcggcagtagtgtttgcagtggtgctgagcatccacgcaaccgtatgggaccgatactcgtggtgcgccgtggccctcgcagtgcaggccttctacgtccaatacaagtgggaccggctgctacagcagggaagcgccgtcttccagttccgaatgtccgcaaacagtggcctattgcccgcctccatggtcatgcctttgcttggactagtcatgaaggagcggtgccagactgctgggaacccgttctttgagcgttttggcattgtggtggcagccactggcatggcagtggccctcttctcatcagtgttggcgctcggcatcactcgcccagtgccaaccaacacttgtgtcatcttgggcttggctggaggtgttatcatttatatcatgaagcactcgttgagcgtgggggaggtgatcgaagtcctggaagtccttctgatcttcgtttatctcaacatgatcctgctgtacctgctgccccgctgcttcacccctggtgaggcactgctggtattgggtggcattagctttgtcctcaaccagctcatcaagcgctctctgacactggtggaaagtcagggggacccagtggacttcttcctgctggtggtggtagtagggatggtactcatgggcattttcttcagcactctgtttgtcttcatggactcaggcacctgggcctcctccatcttcttccacctcatgacctgtgtgctgagccttggtgtggtcctaccctggctgcaccggctcatccgcaggaatcccctgctctggcttcttcagtttctcttccagacagacacccgcatctacctcctagcctattggtctctgctggccaccttggcctgcctggtggtgctgtaccagaatgccaagcggtcatcttccgagtcacactcgggatcctcaaggagtcag

SEQ ID NO: 287482 - DNA, 3185 bp, Homo sapiens
  misc_feature (711)..(711): n is a, c, g, or t
  misc_feature (1206)..(1206): n is a, c, g, or t
  misc_feature (1345)..(1345): n is a, c, g, or t
  misc_feature (1428)..(1428): n is a, c, g, or t
  misc_feature (3003)..(3003): n is a, c, g, or t
  misc_feature (3088)..(3088): n is a, c, g, or t
  misc_feature (3131)..(3131): n is a, c, g, or t
ggcacgagggggaggctggcgcaaacgcagcgggtggctggggtaggggctcattgggagcccacggagcgcggcggcggctcgggggccgagttccctacaacaaggatggcggtgacgggcgcagggagcggggcccggctctccttgcctcgaggctcctctgattccactcgcgtggctgcgcggccctggcagcggccttcgtcccgggggtgggagctacacagggttccgccccgtcctggcgaggacgcctgagggggctctgtggtaaggctctgtcgggcaggccgggcttccgggaggacctggtctggatcggtcaccgctgggtgcctgagctccgcatggagcctgcagcctttgtttaacttataaagaaatgggggctccgagcagtcaagaagaacatgccccaagttattcgtcagtgaggcggaaattgtggtgtacttgttccagaccaactatgaagataggatgcccatccagaagaacgggaagcattttcttcctcacctttggaaagtaaaacaaaaaaaaaaagaaaaataaaagaaaaaagagagtattaaaatttctcattgtaaaatctatattttagaatcactctacaatataagcaaataatgtgttttttactgattacatgccttttttttggggggggggggttctttttttttgagacagggtcttgctctgtcncccaggctggagtgcagtggcgtgatgagacttcaatgcagccttgatctcccgggctcaagtgattctcccgcctcagcctcccaagcaactgggaccacaaggtgtgtgccaccatgcctgggtaattttttgtttttttgtggagatgcgggtctcactgttttccaggctggtctcaaattcctgggctcaagtgatcctcccacttcagcctcacattgttgggattacagtcacgagccactgtacccatccatatgtcattctttagacacactacttactaaatttctctttttaaaggatatactgaatttccggttgagccaacttaactgctaattttctattttagctttaaaacattgataagcaacatgaagcaatctagaacttaacctttaaatggctttattaaagaaatccagctatgaaaatcatgcagaaatgattatttacaaacaatcctaccagcacataagaaattcttcntctattctgaaataccatcttctcacaatatactttgatgttatgaatcaatgtctgttctcgaacattatttgtctttctccattaaacaataccaaaataaaatttccagcacaactaagtattgttgacgataagnggatttaaaaaaaaattcttttaaaacagaagcttatatacaacttagaatctaaaaccaatagatttatggtaaaccttaanactgaaccaaaacaaacaaaaaccaaagttttaatcatttaaaaatcatgtttattgaggtacaacttacttatagtaaaacctgcccttttcagcatatagcactgagtcttgacaaatgcacagttacgtaccaccaccgaccaaggcctggcacattttcacctcctcaaagttctccctggctgcttctcccactccttggcaaccgctaacctgttttctgtccttatagttctgcttttttcagagtgtcatataagtagaatcacactgtacatagtattttgagtctgacctctgtcaactggcataaggcatttgagaattatccatgttgctgtactggcagtgcattcttttttattgctgagcagtattcaattgcatggctgtaccagtttattcatttgccagttgaaggataactgagatcttcctcgtttttagcaattttaaagaaagtttctatgaataattgtgtacaggtttttaattaaatgttttggagatataattcatataccacataattcacctttttaaagtgcataagtcactggtttttaatatattcacaaggtttgtgcataggtttttgtgtgaatactggttttcattcctcttggataaagatttaatttggtattatccttccagacacctttctgtgttttcatacgtatatatgtatgacagtttgaccttaggcagagtagcattttcaaaattttacatggggaaattttctagagttaaagccattttatttttgtgttctgtctggttttatctgcgtgttatttacaatctgctgcgtaacaaattacaaagttagtaccttaacacatatttatttcacagtttctgtgggtcaggagatcagaaatggttctatttcaaggtctctcacagggctgcaatcaagatgttggcatggctggggtctcatctgaaggctggactggagaagaatctacttccaaacttatgtggtagttggaagaatttagttcctcaaggccgctaaactgatggcctgtgttccttgcctatgggatggtagcttgcttcaacaaagtgtgcaagcagagaagacagagagtccgctagcaagatagaagccacaatctcttgtaatctatcatttttgctgtattctactggttaaaaataactcattaggttagcctactggctctcaaggggaagagattatacaaaggcatgaatttctggaggagggaatgagggcaaagaattctgagaagtctgtcttccacaatctgaagaacttctagaaagtaggaggaagcgatattgcttagggatggacaacttggcactggttatgtatttcaagtgaggtaaccttgttcccaagaataaagagaaccagacgactgtaaacatttccctaaactgaaatgcagactgttgtatgttcccctgaaatgaatggtgtaagctgaatataagatttttgacaaaaattttgctgtgttctcagatctggcaggcccctgcccttgtgcaaacaatgttcctggcagctattcatctccttaggtaaanaagaattggagaaaagctgtgctaagataggatgcatttgctcttgccttggaaggttgttttctgataaggttctatatcctcngcaaatcaaatcaggcacttacagtgtgagtatgcattctctncctgccagtctggagatgatcaaaaagcctataacaggcttggcctattttcct

SEQ ID NO: 287483 - DNA, 3096 bp, Homo sapiens
  misc_feature (622)..(622): n is a, c, g, or t
  misc_feature (1117)..(1117): n is a, c, g, or t
  misc_feature (1256)..(1256): n is a, c, g, or t
  misc_feature (1339)..(1339): n is a, c, g, or t
  misc_feature (2914)..(2914): n is a, c, g, or t
  misc_feature (2999)..(2999): n is a, c, g, or t
  misc_feature (3042)..(3042): n is a, c, g, or t
aattccagttggtatggtaccaaaatttagtttaacttcaaaattcacagtactgccgagaaatgggcgggtcctgaggttccagagaagtggggagtgaattcattcctggtggttttattctggcagcatgcatgggaaatcacatgagttagagggctgtggcctgctatcaacacttcaagctgttgtacttttacttcaagatgaaacttttaaaatacatctgtcatatagatgtacaaatatatgtagatgcaaacatatatacacactttttgacaaaagaattgtggtaatatacgtgaaccatttttgtaaatagattctatttggttaataaaaatattccttccatcaacctatcgaagtccagaccaactatgaagataggatgcccatccagaagaacgggaagcattttcttcctcacctttggaaagtaaaacaaaaaaaaaaagaaaaataaaagaaaaaagagagtattaaaatttctcattgtaaaatctatattttagaatcactctacaatataagcaaataatgtgttttttactgattacatgccttttttttggggggggggggttctttttttttgagacagggtcttgctctgtcncccaggctggagtgcagtggcgtgatgagacttcaatgcagccttgatctcccgggctcaagtgattctcccgcctcagcctcccaagcaactgggaccacaaggtgtgtgccaccatgcctgggtaattttttgtttttttgtggagatgcgggtctcactgttttccaggctggtctcaaattcctgggctcaagtgatcctcccacttcagcctcacattgttgggattacagtcacgagccactgtacccatccatatgtcattctttagacacactacttactaaatttctctttttaaaggatatactgaatttccggttgagccaacttaactgctaattttctattttagctttaaaacattgataagcaacatgaagcaatctagaacttaacctttaaatggctttattaaagaaatccagctatgaaaatcatgcagaaatgattatttacaaacaatcctaccagcacataagaaattcttcntctattctgaaataccatcttctcacaatatactttgatgttatgaatcaatgtctgttctcgaacattatttgtctttctccattaaacaataccaaaataaaatttccagcacaactaagtattgttgacgataagnggatttaaaaaaaaattcttttaaaacagaagcttatatacaacttagaatctaaaaccaatagatttatggtaaaccttaanactgaaccaaaacaaacaaaaaccaaagttttaatcatttaaaaatcatgtttattgaggtacaacttacttatagtaaaacctgcccttttcagcatatagcactgagtcttgacaaatgcacagttacgtaccaccaccgaccaaggcctggcacattttcacctcctcaaagttctccctggctgcttctcccactccttggcaaccgctaacctgttttctgtccttatagttctgcttttttcagagtgtcatataagtagaatcacactgtacatagtattttgagtctgacctctgtcaactggcataaggcatttgagaattatccatgttgctgtactggcagtgcattcttttttattgctgagcagtattcaattgcatggctgtaccagtttattcatttgccagttgaaggataactgagatcttcctcgtttttagcaattttaaagaaagtttctatgaataattgtgtacaggtttttaattaaatgttttggagatataattcatataccacataattcacctttttaaagtgcataagtcactggtttttaatatattcacaaggtttgtgcataggtttttgtgtgaatactggttttcattcctcttggataaagatttaatttggtattatccttccagacacctttctgtgttttcatacgtatatatgtatgacagtttgaccttaggcagagtagcattttcaaaattttacatggggaaattttctagagttaaagccattttatttttgtgttctgtctggttttatctgcgtgttatttacaatctgctgcgtaacaaattacaaagttagtaccttaacacatatttatttcacagtttctgtgggtcaggagatcagaaatggttctatttcaaggtctctcacagggctgcaatcaagatgttggcatggctggggtctcatctgaaggctggactggagaagaatctacttccaaacttatgtggtagttggaagaatttagttcctcaaggccgctaaactgatggcctgtgttccttgcctatgggatggtagcttgcttcaacaaagtgtgcaagcagagaagacagagagtccgctagcaagatagaagccacaatctcttgtaatctatcatttttgctgtattctactggttaaaaataactcattaggttagcctactggctctcaaggggaagagattatacaaaggcatgaatttctggaggagggaatgagggcaaagaattctgagaagtctgtcttccacaatctgaagaacttctagaaagtaggaggaagcgatattgcttagggatggacaacttggcactggttatgtatttcaagtgaggtaaccttgttcccaagaataaagagaaccagacgactgtaaacatttccctaaactgaaatgcagactgttgtatgttcccctgaaatgaatggtgtaagctgaatataagatttttgacaaaaattttgctgtgttctcagatctggcaggcccctgcccttgtgcaaacaatgttcctggcagctattcatctccttaggtaaanaagaattggagaaaagctgtgctaagataggatgcatttgctcttgccttggaaggttgttttctgataaggttctatatcctcngcaaatcaaatcaggcacttacagtgtgagtatgcattctctncctgccagtctggagatgatcaaaaagcctataacaggcttggcctattttcct

SEQ ID NO: 287484 - DNA, 2429 bp, Homo sapiens
  misc_feature (711)..(711): n is a, c, g, or t
  misc_feature (1206)..(1206): n is a, c, g, or t
  misc_feature (1345)..(1345): n is a, c, g, or t
  misc_feature (1428)..(1428): n is a, c, g, or t
ggcacgagggggaggctggcgcaaacgcagcgggtggctggggtaggggctcattgggagcccacggagcgcggcggcggctcgggggccgagttccctacaacaaggatggcggtgacgggcgcagggagcggggcccggctctccttgcctcgaggctcctctgattccactcgcgtggctgcgcggccctggcagcggccttcgtcccgggggtgggagctacacagggttccgccccgtcctggcgaggacgcctgagggggctctgtggtaaggctctgtcgggcaggccgggcttccgggaggacctggtctggatcggtcaccgctgggtgcctgagctccgcatggagcctgcagcctttgtttaacttataaagaaatgggggctccgagcagtcaagaagaacatgccccaagttattcgtcagtgaggcggaaattgtggtgtacttgttccagaccaactatgaagataggatgcccatccagaagaacgggaagcattttcttcctcacctttggaaagtaaaacaaaaaaaaaaagaaaaataaaagaaaaaagagagtattaaaatttctcattgtaaaatctatattttagaatcactctacaatataagcaaataatgtgttttttactgattacatgccttttttttggggggggggggttctttttttttgagacagggtcttgctctgtcncccaggctggagtgcagtggcgtgatgagacttcaatgcagccttgatctcccgggctcaagtgattctcccgcctcagcctcccaagcaactgggaccacaaggtgtgtgccaccatgcctgggtaattttttgtttttttgtggagatgcgggtctcactgttttccaggctggtctcaaattcctgggctcaagtgatcctcccacttcagcctcacattgttgggattacagtcacgagccactgtacccatccatatgtcattctttagacacactacttactaaatttctctttttaaaggatatactgaatttccggttgagccaacttaactgctaattttctattttagctttaaaacattgataagcaacatgaagcaatctagaacttaacctttaaatggctttattaaagaaatccagctatgaaaatcatgcagaaatgattatttacaaacaatcctaccagcacataagaaattcttcntctattctgaaataccatcttctcacaatatactttgatgttatgaatcaatgtctgttctcgaacattatttgtctttctccattaaacaataccaaaataaaatttccagcacaactaagtattgttgacgataagnggatttaaaaaaaaattcttttaaaacagaagcttatatacaacttagaatctaaaaccaatagatttatggtaaaccttaanactgaaccaaaacaaacaaaaaccaaagttttaatcatttaaaaatcatgtttattgaggtacaacttacttatagtaaaacctgcccttttcagcatatagcactgagtcttgacaaatgcacagttacgtaccaccaccgaccaaggcctggcacattttcacctcctcaaagttctccctggctgcttctcccactccttggcaaccgctaacctgttttctgtccttatagttctgcttttttcagagtgtcatataagtagaatcacactgtacatagtattttgagtctgacctctgtcaactggcataaggcatttgagaattatccatgttgctgtactggcagtgcattcttttttattgctgagcagtattcaattgcatggctgtaccagtttattcatttgccagttgaaggataactgagatcttcctcgtttttagcaattttaaagaaagtttctatgaataattgtgtacaggtttttaattaaatgttttggagatataattcatataccacataattcacctttttaaagtgcataagtcactggtttttaatatattcacaaggtttgtgcataggtttttgtgtgaatactggttttcattcctcttggataaagatttaatttggtattatccttccagacacctttctgtgttttcatacgtatatatgtatgacagtttgaccttaggcagagtagcattttcaaaattttacatggggaaattttctagagttaaagccattttatttttgtgttctgtctggttttatctgcgtgttatttacaatctgctgcgtaacaaattacaaagttagtaccttaacacatatttatttcacagtttctgtgggtcaggagatcagaaatggttctatttcaaggtctctcacagggctgcaatcaagatgttggcatggctggggtctcatctgaaggctggactggagaagaatctactcaccgggatctcagatcacc

SEQ ID NO: 287485 - DNA, 796 bp, Homo sapiens
tgggccagtagccgagccgcggtgacgaaccggctccgcggttgcggtgtttgcggttgctgtgatggcgatgtgagggggcccggggcgggatggtgctgacccgggtcgggccgtcttcttgcagctggacaacgagctcctccgttcgacaggcgggggaagaggccgagccgggcgagagggttgaagatcaactggattatgtatttggttctggaatctcaaagcagtccacaaacaaattcttccttatgttgtctgtgtcagagtcccactgtattgcctctacctcccggattcaagcgattcatgtgcctcagcctcccaagtagctggaattacatgcccaggccaccacacctggctaatttttgtatttttagtagagatggggtttcaccatattggccagcaggtctcaaactcctggcctcaagtgattctcccgcctcagccacccaaagtgctgggattacaggcatgaactactatgcctggctgtagtctgggacatttctgttaagtgttatgaaatgttcttttgctactggtcttaatttaacctgaactagaataagtattcctttattgaaatacccttgaagttgcctataggatgcagctgtttcattcatgattgtttttagagcagtgttaactatgacacttgctctttgatgtcttcagattgccagcaagtcaagggcttacattggaaatactgctatctataaatgtctaagcagcaaggtcagcccttattggcaataaaaaatgtaagactgtggaagcc

SEQ ID NO: 287486 - DNA, 280 bp, Homo sapiens
ctcctccgttcgacaggcgggggaagaggccgagccgggcgagaggtaacccccttactgtcccctctggctcccccggctcccgacacccacgacccctccctccgtccctcttgcccaggggccaggaaggaagcggcctcctcttcgtccgccgttcgcccgccgcggcccctcacccgactgctggcggtcggagcctggccccggccccgttgaaggtcggtggggacggcggtgcggagcgctctgagggaggcgaggggccgcggcgcgctgc

SEQ ID NO: 287487 - DNA, 767 bp, Homo sapiens
aaagcccaaagccatagtattggcttctctgtgtgtcgggcagtaagcccattgcttggtagcaagtctgtcttcactgtctaaaaaatgctttgatcaatagctccctgcccctcctctagtgatctagacccatccgtagtaatttcactcttttcccgaggacaaagtctggtgggaaagaaacactgaggctaacatcagcttcctaaagtcatgattccacatttggcaggcagatggacccaccagtctctgattatggccagtctttgaacacctgactccactttctacctgcagtctccactgtagcttattttagtctcaagcaagtaaatacctgggaaggtttagtagctcacctgtgaaaatacatgttaattttccaccctggaatttaataagctccttgagggcaggggtggcattttcatttttatttctctaacacctgacacaaacgtttggtgtctagtttaggtcctcaataaatgttagttgaataaacagttttctctctgttaactctcctctctaatggcagttttttcaaaatccaggcacggattgggcttactgcacacttcagcgtaggagcacgtcggttcaccattagagtaacggatctcaggggtcaaagttgtggactcaatcgtagaggaaaccactgggctcaccaagagaatgatcgtttccggcccctttctacataacttcatgcaacacggagactcctgaaagttgtagatgagttggatttctga

SEQ ID NO: 287488 - DNA, 318 bp, Homo sapiens
accctccaattgcagacacaatattacatgagatgccgtttgaagctttcacctggagttggcacatctctgaaactccaaacacataacaataatagttttttcaaaatccaggcacggattgggcttactgcacacttcagcgtaggagcacgtcggttcaccattagagtaacggatctcaggggtcaaagttgtggactcaatcgtagaggaaaccactgggctcaccaagagaatgatcgtttccggcccctttctacataacttcatgcaacacggagactcctgaaagttgtagatgagttggatttctga

SEQ ID NO: 287489 - DNA, 436 bp, Homo sapiens
tctcattgaggtgaggtggtttggattcacctgctcgcttaggaggttttagagtcccgcactccttttccccacctccttccagaatgtcaggaaactgagaatgcagattcctgcagaaagtggcctcttgttcactaaaggtaaaggtttcacctctggtgagattaaagaagaaaggcctcccaggtgatgctcattcacagggaacttgtacagattctggggggaggaaaaaagggggaaagggctgaaaacaaaactgttgggtgccatgcgcactacctgggtgacaggatcattcatgtcccaaacctcagcatcatgcaatataccctcgtaacatacctgtacatgcaatccctgaacctaaaataaaagtggaaattatttttctttatcgggagtttgagaccattctgaccagtgtagagaa

SEQ ID NO: 287490 - DNA, 1134 bp, Homo sapiens
ctatttttcccacagtctctataacctaagggaagtacatattctttgatctaagaattccactgctgcaacaaataagggattagagaaataaatgatcatacatcctcccaatagaatacgtacaagtattaaaaagaatgagagatatttacatgaaaaatctgaaagaatatatgccaggctattaatagtagctatatatcaggcaagagagcaagggatggcactgaggggaataagattatactggtcttcagattttttccatatttaaaaaaagtaacacacacataacttggtaaccagaataaatttcttttgcatagggaaagaattaggaccttccaaatgaaaacaagtagagttatagttttaaaggaaagtgcagcccaaggtaatacagaggaaaggcagtaaatgcgcatggggaatgggtgggcaggaggtgctggggggctgtcaggggctcatcaaggggcctttaccttggataattcatcagggcccaaggtcgagggtctgggcctctgccttgaatctctgcttcagggtcaaaaccctggccagcaagagatgagggtgtggaaggcacctctctttggaggctatggtcatgaacactggccaatttccagctcttaacgtgtccctttcttgcctttggcctcaccatcctcctctgtcctaatgatcttccttccactttggaaatcacaattgcattctaatcctgcttccttgggattgttaccagagtaccaaaattggagcggtgggtgttcttacatgctttagtcacagatttgccgataatctcgtggttactcccacaggtgactgatcacatccatcaggcatgacttgattatatgagagtgtaacatcattccaacagtaacagaggcataactggtgtgcattatgctaggcgaattctaaatgctgtgtttcatctcactcctgggctaaatgaccctgtgtgacccagtgatgtacctgctctcccaactctgacccggcagtgcccttgcctgtgggtgtggagtgaggatgtggagactaaacagcattggtgttcgctccttcttcttaagcttctcccagtctaaaataaaacaatttctccctcta

SEQ ID NO: 287491 - DNA, 474 bp, Homo sapiens
tgtccttcccaggagccccaaggtctcagctgcccacgctccccagtgtgatgcctactctagccaaccaagaggagcacaagcaaaggaactgtccatggatgaggcagaggaggagctgagaggagccagccttaccattctgaccactggggattgtacctcctgagctataggtgactgatcacatccatcaggcatgacttgattatatgagagtgtaacatcattccaacagtaacagaggcataactggtgtgcattatgctaggcgaattctaaatgctgtgtttcatctcactcctgggctaaatgaccctgtgtgacccagtgatgtacctgctctcccaactctgacccggcagtgcccttgcctgtgggtgtggagtgaggatgtggagactaaacagcattggtgttcgctccttcttcttaagcttctcccagtctaaaataaaacaatttctccctcta

SEQ ID NO: 287492 - DNA, 543 bp, Homo sapiens
ggtcccgctgttcccacgtctgcctccctaccagactgagctccaagctgccaggggcctcgtctccatctgggtcccagttcccaccatagagctgggcatggaggacagctcagggaagcttcttgggaaatgaattctgggagttccctctgccaaggacccactgtgttaagagctttaagtcccccttcctcccaggtgaatgtccacttcgaggccggctcaaccaccgtcttcagagaactctcccacactggccacagcctatctgccagcgtcacccactgtctaggtctttgcccataatgtgtcaagggcaaaacagaggggtggatatgatgcacgtgcctcagcccggggcccgtacatggctggcgtccagctgggccaggggagcaggaagacccctggagcaccggaagcaagaaagaggcaggcaggggcggctagccaggtttgtgctcggactattcacacagagacatgtggcagcttacgttggacaaaacgagtaataaaaattggctttaaatatggaaa

SEQ ID NO: 287493 - DNA, 885 bp, Homo sapiens
ggtcccgctgttcccacgtctgcctccctaccagactgagctccaagctgccaggggcctcgtctccatctgggtcccagttcccaccatagagctgggcatggaggacagctcagggaagcttcttgggaaatgaattctgggagttccctctgccaaggacccactgtgttaagagctttaagtcccccttcctcccaggtgaatgtccacttcgaggccggctcaaccaccgtcttcagagaactctcccacactggccacagcctatctgccagcgtcacccactgtctaggtctttgcccataatgtgtcaagggcaaaacagaggggtggatatgatgcacgtgcctcagcccggggcccgtacatggctggcgtccaggtaacgcaggcctggggcagacattccttacacagctcccaccctactcttacgtccacatttaggcagccaggccaccttagccttggaggggaggacaccaacggggcccgccttaccagcagtcagaaacagacccacatcccagtgggtacccaaggcttctttccttaggccccatcccatttaggaagttgggaaacccactgggtgagcccaaaggctaccaaagcctggctgtctggagaggctagttcagagtcagccctgggggctcctgggcctcggaagggcacaccctgcttccctccaggcccacctccaatcccttcccgcttccagctgggccaggggagcaggaagacccctggagcaccggaagcaagaaagaggcaggcaggggcggctagccaggtttgtgctcggactattcacacagagacatgtggcagcttacgttggacaaaacgagtaataaaaattggctttaaatatggaaa

SEQ ID NO: 287494 - DNA, 749 bp, Homo sapiens
gttcgtcctgcggctcgctggcgatctgccgcagcgtggccttgtccacgctgcccactccgatggcgaacagctcgacgccgctggcccgggcccgcgcagacacgtcctgcacgctgtcctggggcctcccgtctgtcaccacgatgaccacctgcgacacgcggggcggtgtgacaccgggctcccggaagcccacgggactgtccaggagaggaggctgaggcccggagaggcgggaggactgccgggtcgcacagccaggcggcacccgggggaagaggacccggctggccgaagaggagacccgtttcctctgactgagagacgtggctggggggctttccatctgcttcgcctccctcgggcaggcagctctgagatgcccggagggatgtgatgccccatcgccaaattggggtctctaagctatgaaatggccacctcacggggcatcatgggaatcaaagtgtctgcaggcaaagctcataactccgagcgggagcctccaaacagcagcatcctagcagggtggcgtgcacgtaccttgctgatgtcaggggacctggaacgaccaccctctgcatcgccgaaggctttggtgatagcgaactggatggccaggccggtcatggtgcctgtggacagcggctggatacggcgcacagcctgcagcagtgcggccttggagacatgagcccgcagcgagaactcctgcttcacggtgctggcatagttgaccatgccca

SEQ ID NO: 287495 - DNA, 864 bp, Homo sapiens
cagagataaagagtggaggaagaaagtgagagccagagagagacagaaacagggaatgaccatttacatatgtacacataggctacagcaagacttcatccccagatccactgtggtttccaactcctgaaatacttggaatgaggtggaagaagcaaagaaagaagggagcagagcatttgtgttgtcttgttgagaaggcagaagcaaacagatgaggtagaaggttactgtaatattccagacaaatgatgatgcagcttgaagaatgtggtaactgtggcgatacaaagcagtcaaaatcaggaagtactgtgaaggtagagccaacgggatgtgccgtcaaattggatatgggtggaaaataaaaagaagggtccaagataatgccaaggttttttgctgaacaactagaaagatgaagctgccattcaccgagaagggaactaatgcaggaggagcaggttttggggtgacaatagggagctcagtttcagatctgttcaatctgtgatgtgtatttaacatgaaaacggagatgccaaataggcaccggctagacaagtgtgaagagaacttctggctggagatgtaaactcaagaggtgtgggccttgagactggatcagttcaccaagggaataagagtaaagagaagagaaacagtgcaaggcctgggttgtaggcactcaaaccttcagaggtcacagaggtgaggagggatcagtctttactggaaaggagtaaccagtgtgataacaggagaatcgagaggagaggagaggggctgggagggtgactaacgcctataatcccagtactttaggaggctaaagtgggaagactgcttgagctcaagagttca

SEQ ID NO: 287496 - DNA, 910 bp, Homo sapiens
tttgagacttgaagaatcagtctcccaaaggagcatcagagcagattttgatgctggcaccagcctttgacttctgcttggctggccccatctcttagatccctgcttgactgacagcccaattctgtcgagcccttctctataacggtcattacaaacaaccctgaagtggctggaatatagtcagcaaggggcccacatgaacagctcatctggaatctttgcaaaactgtgccgacttctctggtggctacggctgcggctacggctgctggagcgggacctgtggcgatggcgtttctcccgagatttggatcgagttctcctcttgcgttcacgtgacatggagcgagatcgatgtctgcgatgctctctggacctggatctaccagacaagatttgattttgtttctacctttgtaattactatatttctcatttattaaagccttttctttaaagagaaactttttttcagtagtcttaatgtcaattatattccaagtcagctaaatctacactgaattgctggtgtgttaataactacatactagaattcaaaataaaacattaataattctcagccaggcgccgtggctcacacctgtaatcccaacactttgggagtctgaggcaggaggatcgcttgagctcaggatttcaagaccagcctaggcaacatggcgaaactctgtctctataaaacatacaaaaattagctggacacagaggcacatgcctgtagtcccagctactcaggaagctgaggtgagagaatctcttgagccagggaggtcaaggctgctgcaatgacctggtgatcacatcgctgcagtccagcctgggcaaaagagtgaaattctgtctcaaaaacaagacactgattgataattctcagagagcaatcagt

SEQ ID NO: 287497 - DNA, 836 bp, Homo sapiens
cactctcataggaccgcttcttatctttccgatctctgtcacgaggtgatctgtctcttgaactcctgtctctgtcacatgatgctaagtcttggtctctgaatctttcttttgaggatctcctcttggatcgttctctgctcctatctctagaactgtgccgacttctctggtggctacggctgcggctacggctgctggagcgggacctgtggcgatggcgtttctcccgagatttggatcgagttctcctcttgcgttcacgtgacatggagcgagatcgatgtctgcgatgctctctggacctggatctaccagacaagatttgattttgtttctacctttgtaattactatatttctcatttattaaagccttttctttaaagagaaactttttttcagtagtcttaatgtcaattatattccaagtcagctaaatctacactgaattgctggtgtgttaataactacatactagaattcaaaataaaacattaataattctcagccaggcgccgtggctcacacctgtaatcccaacactttgggagtctgaggcaggaggatcgcttgagctcaggatttcaagaccagcctaggcaacatggcgaaactctgtctctataaaacatacaaaaattagctggacacagaggcacatgcctgtagtcccagctactcaggaagctgaggtgagagaatctcttgagccagggaggtcaaggctgctgcaatgacctggtgatcacatcgctgcagtccagcctgggcaaaagagtgaaattctgtctcaaaaacaagacactgattgataattctcagagagcaatcagt

SEQ ID NO: 287498 - DNA, 635 bp, Homo sapiens
accatcattcagcctctcatctcctggtaacattttctggaaatacattttttaaattatttgcacggtgtaacttctataagatcgatgtgtcagagtgccgacttttacttagattctatgtgactctttcaacaaattcattctttcagcaaatatgcattgaatacctagcatgcgctgggtcttgctctaggtgctgaggatactgtggcctcccagtcaggcagtgtgacagggagaaccacgactgtgcgtaggttattctcctctgacctcacaacctttttgatgtacatgtggtcatctccattcctcaatgcagccacaggctgggagggtggagcctgatataagccaggcccattgactccaaacccaggtcctcctgcatcctcacaggcttctttctgattctgcatcctcctttctagatcaacccagaacgccatgaccgcaggctgaatcacttcagggtctgcagtgacatcactctgtacaaggctaaaacgtggggcttaggagatgatcaccacaagtagcatcccagcggatgagcccatctgtggatctaatgccttaagtgtgcacagcccagagaaataaaatactactttaaaacgaaaaatcacttt

SEQ ID NO: 287499 - DNA, 638 bp, Homo sapiens
gacgccgttgcctggagacagcggggacgcgttgcctggagactgtggaaggcccaggcaagagggcgcgtggcagcccaaggccatggcgggacacccaaaagagaaggtgattccagatgaggtccatcagaaccagatcttgcgggaactgtacctcaaggagctacgaacccagaaactctacacgcagtatcacgtgaatcccctccgcaagagtgagagttcatacagtcaccaggaagcccatgtcttggcatgataacctggaggaacctgcagatgccaggtttctgaatctcattcaccatgctgcccagggaccaaggaagaagtacccagagacacagactgaaaaccaggaagttggatgggacttagagcccttggtaagcgtggctccttcctcaggaaatacgaggaaacacagcagcaatatcaacccagaacgccatgaccgcaggctgaatcacttcagggtctgcagtgacatcactctgtacaaggctaaaacgtggggcttaggagatgatcaccacaagtagcatcccagcggatgagcccatctgtggatctaatgccttaagtgtgcacagcccagagaaataaaatactactttaaaacgaaaaatcacttt

SEQ ID NO: 287500 - DNA, 590 bp, Homo sapiens
gacgccgttgcctggagacagcggggacgcgttgcctggagactgtggaaggcccaggcaagagggcgcgtggcagcccaaggccatggcgggacacccaaaagagaaggtgattccagatgaggtccatcagaaccagatcttgcgggaactgtacctcaaggagctacgaacccagaaactctacacgcagtatcacgtgaatcccctccgcaagagtgagagttcatacagtcaccaggaagcccatgtcttggcatgataacctggaggaacctgcagatgccaggtttctgaatctcattcaccatgctgcccagggaccaaggaagaagtacccagagacacagactgaaaaccaggaagttggatgggacttagagcccttgatcaacccagaacgccatgaccgcaggctgaatcacttcagggtctgcagtgacatcactctgtacaaggctaaaacgtggggcttaggagatgatcaccacaagtagcatcccagcggatgagcccatctgtggatctaatgccttaagtgtgcacagcccagagaaataaaatactactttaaaacgaaaaatcacttt

SEQ ID NO: 287501 - DNA, 380 bp, Homo sapiens
cagcgagactccgtgggcgtaggaccctccgagccaggtgcgggatatcatctcgtggtgcgccgtttaagccagtcggaaaagcgcagtattcgggtgggagtgacccgattttccagttcatacagtcaccaggaagcccatgtcttggcatgataacctggaggaacctgcagatgatcaacccagaacgccatgaccgcaggctgaatcacttcagggtctgcagtgacatcactctgtacaaggctaaaacgtggggcttaggagatgatcaccacaagtagcatcccagcggatgagcccatctgtggatctaatgccttaagtgtgcacagcccagagaaataaaatactactttaaaacgaaaaatcacttt

SEQ ID NO: 287502 - DNA, 486 bp, Homo sapiens
gacgccgttgcctggagacagcggggacgcgttgcctggagactgtggaaggcccaggcaagagggcgcgtggcagcccaaggccatggcgggacacccaaaagagaaggtgattccagatgaggtccatcagaaccagatcttgcgggaactgtacctcaaggagctacgaacccagaaactctacacgcagtatcacgtgaatcccctccgcaagagtgagagttcatacagtcaccaggaagcccatgtcttggcatgataacctggaggaacctgcagatgatcaacccagaacgccatgaccgcaggctgaatcacttcagggtctgcagtgacatcactctgtacaaggctaaaacgtggggcttaggagatgatcaccacaagtagcatcccagcggatgagcccatctgtggatctaatgccttaagtgtgcacagcccagagaaataaaatactactttaaaacgaaaaatcacttt

SEQ ID NO: 287503 - DNA, 375 bp, Homo sapiens
aggaaagggcacaggaccaacctctggtcccaaagcctgactccttcataactcatacctcgtctcccagccaggtttctgaatctcattcaccatgctgcccagggaccaaggaagaagtacccagagacacagactgaaaaccaggaagttggatgggacttagagcccttgatcaacccagaacgccatgaccgcaggctgaatcacttcagggtctgcagtgacatcactctgtacaaggctaaaacgtggggcttaggagatgatcaccacaagtagcatcccagcggatgagcccatctgtggatctaatgccttaagtgtgcacagcccagagaaataaaatactactttaaaacgaaaaatcacttt

SEQ ID NO: 287504 - DNA, 633 bp, Homo sapiens
gacgccgttgcctggagacagcggggacgcgttgcctggagactgtggaaggcccaggcaagagggcgcgtggcagcccaaggccatggcgggacacccaaaagagaaggtgattccagatgaggtccatcagaaccagatcttgcgggaactgtacctcaaggagctacgaacccagaaactctacacgcagtatcacgtgaatcccctccgcaagagtgagagttcatacagtcaccaggaagcccatgtcttggcatgataacctggaggaacctgcagatgccaggtttctgaatctcattcaccatgctgcccagggaccaaggaagaagtacccagagacacagactgaaaaccaggaagttggatgggacttagagcccttggtctcttctacagaaaaagacataccacatctggtcacatagcagcttgccttctgccccagggtgaggacgaacagaactgaagggagagggcagggttgggagtgggaggggaggctgagcctgctcctcacccgggcacctgggctcacttacatttgaccctttcttgccaggcctcttgaggcctctgccatgagctgtcttggcccggaagctagatacatcatcatagctctcccga

SEQ ID NO: 287505 - DNA, 430 bp, Homo sapiens
aaggtattatcagtaagcccattttacagatggggaaactaaagctcaagagacggttaggtgacttaggacaatcaaaaatgactagtcaaaccaatgatctagccaatttctagtgccggtgagtgggaagagtggtgaagaccctaagacatataccccgtgggcgcctaaagcactaagctcacgacgctgggaaagcggggccgagaaggagggactcggggcgacccgacagcgccagacagggcggccggcgccgagggccgctacctcggtgcggcggtacagcgtggcttccccgaaggcgccgcggcccaggacgcggatggggatgtagtgcagttcctcctgctccgccgcgccgccgccggctcgcggcccctgactggcgctaggccccggactcgagtccccgcaacccccggac

SEQ ID NO: 287506 - DNA, 473 bp, Homo sapiens
aattcagtgggcacctactaccatttggtagtaggcacttggaatgcaataggctattgtcgctttcctgatggggcatgttagggagggaggaacatgtcagaaaatacaagacttaccccatcactgagctgtccagcatcagtcacagaacccatcacttttatacctaattatcacaagtcaacaggatatggaatatagacaaggggaaggaagacgaggggggaaaagagaacaagctatattctgacttgtactgcagatgttcaggaaacgttcctgatagcaatgattggtgtaatgattgtagctccaagattactaaaccttctgaagtactcattgtgtataaaatcagaggcaaaaatacaatttattttctgactagcaattcaaagctatttctctttatttaacaaatgtactgcatactcttcttttggaatgctgtctgaatgtccagagaataa

SEQ ID NO: 287507 - DNA, 2903 bp, Homo sapiens
  misc_feature (8)..(8): n is a, c, g, or t
  misc_feature (425)..(425): n is a, c, g, or t
ctctctcnctctccctctctccctctccctctctccctctccctctctcctctctctcctctctcctctctctcctctctcctctctctctgctggctggctggctgtctaggcctatgtgtcaccacctggcacttgctctcattgtcttgtgcgagtgcttttgccagcagtttggagtgcagacccatcacccctcactggggccccccatgaggcctgcctgactgcatgccccacccgggcccatggcagcgcacctggaagcggacggctgaggacttgttgcagtgcatggagatgggcgcgaagctgtacagggccttcagtacgtcgcggttgaaggagttccagggaacagaggtgaactgctgagacacggacgcctgagggcaggtgcagacatcctcgttgttgaacctggnggggacaaggaacagccaggctggggagcagctgacgggcagggagcccagtgggcaccagcaacacctccctgcaactcgagtcctgtccctggggcaaccgtcctgccacctcctccccagccccgctgcctccgccaggccaccccagatgctgccttcaccggcaacggcctcacctctcctgtcaccttggcgggtgggtaatggctgctgcaggctgggttgaggaggctctgaagccaaatccagactcagcaggaaacgagtgaggggaggggtgagtgatgccgccacaggtctctgctcctagaacttagcctggactcctccaatctgcccagccgcctaacaggcccgaggttctgtgtcggggttccctgggggcagggagcttgtgcagggagccctcacctgttgatgaggtggaagtacttctgcaggaagccggcgtccacagcgctcttgcagagctccagctgcgtctgggggtagtagtgcacgtagttgacacacatctcctccaggatcccgaagcccccctgcaagttggaggagacccgtcagccccgggccatgccacgcagacgctgccatccagcagctttcgccgcacccacgtgtacactgcgtccactcgtctgttcactgcaccgtgccaggcatgctctggggaaccgagtccctgccctcaaggaattgccaccattggcaggagagacaggcagtgagtgagtgagtcaaccaggaaattcgtatcaggtactgatgatgctgtgaggaaaaatgaaacgggacaagcggatggggtgttattgtgcccattttatgggtacagaaactgagtctcagagcaggcaaggggatgccccgtggtggccacagcatcggtggcacagcctgagtgcacccagcgtcccggccattgtctggaagctgtccccatgacctccagcgagagcctggagccaaggactgcaagggaggccctttccactgcagccccgcaccgtccaccagtcatttctccaacgtggctctgaggggagcagggactctataagacaggaccgtgactagaggccgcgacaacctccagcctctcacggcaaccctacggcctgccatcgcatgggaggggcagggcaggcaccctctgagtccccactgccagctttaagcccctcgctgggttgctgctcttggagctggtgaccgtggagcctcagccataggaggaagaacagcagcagcttggaggagctggggctggagagagcaaagctcccccggcagcagctcagatcccagcaggtcaggggccgggacatgacgccctggccacccttgcccctccaggctccccgctgtttgtgaagctgctgtgggcctggggatttcatctggctggtggggaagaaaggcaatctttactctatggcagaacaaagggactgggcaaagcttggcgtggcacttacaccagctgccgccccctcctcccgtgcagacaaagagcatggggcagttctgcccagagacgaaacctggcacctgttggccaggacgcgtttttgccagcattgttctctgggccggattcctcctttcccagcttttctcatccatcccgcccccgtcagatcgggacgattgccctcctgtgtgagttcctgtccctccccaccctctgccaccacagacatcaaaagggaactgagtccgaccctgtgtagaatctgttctcctctttcacctggggaaggaaatcgaatttcaaaggccactgtgtcttggatcagcaggcgagggcttgtcagagtgtgagaagctcaggtccacctggggagctgccctcccctttgatcccacctggtgctgtgatgtggccactgccaagaggaggacatgggccagggaagccacagaactgcccacggggacgctggcaccgagggcctcaacctgcagaacggccatctgagatgtccgcggtgctcaccaggcctggcagccccgaacgccctgggacgtggcgtcagttccgccgccgtgaagccagattgggcagggaatatgcagtctcctcgctggatgcccggcaagaccctcccatccctggccccggggccgcgcctgcagaatggggctgatggtggggacttgcctggggtgctccacctgcagagccctctgtttgcgagcccactcagtcactgcacaggtgcttagccgagaggcggcacagtcggggttggcacctgcacccataccagccctgcctcctgttcgctgtgtggcctgagtggctggacctcactgtatctcctggtgggattgctcagaggtctcagcaaggcttggtgtggttaggatgagttattagagcagtgctgagctgtggcaagcacccgacatcagccactgctgtgatatactgagcacctcctctagagagaataaaggactgacaaagct

SEQ ID NO: 287508 - DNA, 2314 bp, Homo sapiens
  misc_feature (8)..(8): n is a, c, g, or t
ctctctcnctctccctctctccctctccctctctccctctccctctctcctctctctcctctctcctctctctcctctctcctctctctctgctggctggctggctgtctaggcctatgtgtcaccacctggcacttgctctcattgtcttgtgcgagtgcttttgccagcagtttggagtgcagacccatcacccctcactggggccccccatgaggcctgcctgactgcatgccccacccgggcccatggcagcgcacctggaagcggacggctgaggacttgttgcagtgcatggagatgggcgcgaagctgtacagggccttcagtacgtcgcggttgaaggagttccagggaacagaggatcccgaagcccccctgcaagttggaggagacccgtcagccccgggccatgccacgcagacgctgccatccagcagctttcgccgcacccacgtgtacactgcgtccactcgtctgttcactgcaccgtgccaggcatgctctggggaaccgagtccctgccctcaaggaattgccaccattggcaggagagacaggcagtgagtgagtgagtcaaccaggaaattcgtatcaggtactgatgatgctgtgaggaaaaatgaaacgggacaagcggatggggtgttattgtgcccattttatgggtacagaaactgagtctcagagcaggcaaggggatgccccgtggtggccacagcatcggtggcacagcctgagtgcacccagcgtcccggccattgtctggaagctgtccccatgacctccagcgagagcctggagccaaggactgcaagggaggccctttccactgcagccccgcaccgtccaccagtcatttctccaacgtggctctgaggggagcagggactctataagacaggaccgtgactagaggccgcgacaacctccagcctctcacggcaaccctacggcctgccatcgcatgggaggggcagggcaggcaccctctgagtccccactgccagctttaagcccctcgctgggttgctgctcttggagctggtgaccgtggagcctcagccataggaggaagaacagcagcagcttggaggagctggggctggagagagcaaagctcccccggcagcagctcagatcccagcaggtcaggggccgggacatgacgccctggccacccttgcccctccaggctccccgctgtttgtgaagctgctgtgggcctggggatttcatctggctggtggggaagaaaggcaatctttactctatggcagaacaaagggactgggcaaagcttggcgtggcacttacaccagctgccgccccctcctcccgtgcagacaaagagcatggggcagttctgcccagagacgaaacctggcacctgttggccaggacgcgtttttgccagcattgttctctgggccggattcctcctttcccagcttttctcatccatcccgcccccgtcagatcgggacgattgccctcctgtgtgagttcctgtccctccccaccctctgccaccacagacatcaaaagggaactgagtccgaccctgtgtagaatctgttctcctctttcacctggggaaggaaatcgaatttcaaaggccactgtgtcttggatcagcaggcgagggcttgtcagagtgtgagaagctcaggtccacctggggagctgccctcccctttgatcccacctggtgctgtgatgtggccactgccaagaggaggacatgggccagggaagccacagaactgcccacggggacgctggcaccgagggcctcaacctgcagaacggccatctgagatgtccgcggtgctcaccaggcctggcagccccgaacgccctgggacgtggcgtcagttccgccgccgtgaagccagattgggcagggaatatgcagtctcctcgctggatgcccggcaagaccctcccatccctggccccggggccgcgcctgcagaatggggctgatggtggggacttgcctggggtgctccacctgcagagccctctgtttgcgagcccactcagtcactgcacaggtgcttagccgagaggcggcacagtcggggttggcacctgcacccataccagccctgcctcctgttcgctgtgtggcctgagtggctggacctcactgtatctcctggtgggattgctcagaggtctcagcaaggcttggtgtggttaggatgagttattagagcagtgctgagctgtggcaagcacccgacatcagccactgctgtgatatactgagcacctcctctagagagaataaaggactgacaaagct

SEQ ID NO: 287509 - DNA, 1518 bp, Homo sapiens
  misc_feature (8)..(8): n is a, c, g, or t
  misc_feature (425)..(425): n is a, c, g, or t
ctctctcnctctccctctctccctctccctctctccctctccctctctcctctctctcctctctcctctctctcctctctcctctctctctgctggctggctggctgtctaggcctatgtgtcaccacctggcacttgctctcattgtcttgtgcgagtgcttttgccagcagtttggagtgcagacccatcacccctcactggggccccccatgaggcctgcctgactgcatgccccacccgggcccatggcagcgcacctggaagcggacggctgaggacttgttgcagtgcatggagatgggcgcgaagctgtacagggccttcagtacgtcgcggttgaaggagttccagggaacagaggtgaactgctgagacacggacgcctgagggcaggtgcagacatcctcgttgttgaacctggnggggacaaggaacagccaggctggggagcagctgacgggcagggagcccagtgggcaccagcaacacctccctgcaactcgagtcctgtccctggggcaaccgtcctgccacctcctccccagccccgctgcctccgccaggccaccccagatgctgccttcaccggcaacggcctcacctctcctgtcaccttggcgggtgggtaatggctgctgcaggctgggttgaggaggctctgaagccaaatccagactcagcaggaaacgagtgaggggaggggtgagtgatgccgccacaggtctctgctcctagaacttagcctggactcctccaatctgcccagccgcctaacaggcccgaggttctgtgtcggggttccctgggggcagggagcttgtgcagggagccctcacctgttgatgaggtggaagtacttctgcaggaagccggcgtccacagcgctcttgcagagctccagctgcgtctgggggtagtagtgcacgtagttgacacacatctcctccaggatcccgaagcccccctgcaagttggaggagacccgtcagccccgggccatgccacgcagacgctgccatccagcagctttcgccgcacccacgtgtacactgcgtccactcgtctgttcactgcaccgtgccaggcatgctctggggaaccgagtccctgccctcaaggaattgccaccattggcaggagagacaggcagtgagtgagtgagtcaaccaggaaattcgtatcaggtatgatggtggggacttgcctggggtgctccacctgcagagccctctgtttgcgagcccactcagtcactgcacaggtgcttagccgagaggcggcacagtcggggttggcacctgcacccataccagccctgcctcctgttcgctgtgtggcctgagtggctggacctcactgtatctcctggtgggattgctcagaggtctcagcaaggcttggtgtggttaggatgagttattagagcagtgctgagctgtggcaagcacccgacatcagccactgctgtgatatactgagcacctcctctagagagaataaaggactgacaaagct

SEQ ID NO: 287510 - DNA, 2664 bp, Homo sapiens
cgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctaggaacagctatggaatggttaaagacatcattgcttttggctgtttacaagacggttccaattttggaattgtccccacctctgtggacagccattggctgggtccaaaggggccccaccccccctactcctgtcctccgggttctactgaagtgggcaaaatccccgagaagcagcggtgtccccagcctctcactcggagccgatatggggagtaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaacccgaggcctcttgtgcttccagaaccctccagttgttcacctttctgcactgaaaggcacttaagtgacactccaggagaaccttccccatctctggagaaggagctccctctgccatctgtgtaggttatgaaatgattgaggggaggccgggcgcagtggctcacgcctgtaatcccagcactttgggaggccgaggagggcggatcacttgagaccagaagttcaagaccagcctggccaacatggtgaaacctcatctctactaaaaatacaaaatttagccgggtgtggtggtgcatgcctgtaatcacagctactcgggaggctgaggcatgagagtcgcttgaatctgggagatggaggttgtagtgagccaag

SEQ ID NO: 287511 - DNA, 2153 bp, Homo sapiens
  misc_feature (2145)..(2145): n is a, c, g, or t
  misc_feature (2150)..(2150): n is a, c, g, or t
cgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctaggtaagcaacgtgtatgaagatgctgcattggcccacagaaggcaaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgggattgcccgagaaaaaaaaggttaaaaaaaaaaagctgtngcggnagc

SEQ ID NO: 287512 - DNA, 2445 bp, Homo sapiens
cgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaacccgaggcctcttgtgcttccagaaccctccagttgttcacctttctgcactgaaaggcacttaagtgacactccaggagaaccttccccatctctggagaaggagctccctctgccatctgtgtaggttatgaaatgattgaggggaggccgggcgcagtggctcacgcctgtaatcccagcactttgggaggccgaggagggcggatcacttgagaccagaagttcaagaccagcctggccaacatggtgaaacctcatctctactaaaaatacaaaatttagccgggtgtggtggtgcatgcctgtaatcacagctactcgggaggctgaggcatgagagtcgcttgaatctgggagatggaggttgtagtgagccaag

SEQ ID NO: 287513 - DNA, 2520 bp, Homo sapiens
cgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaattccaggactgggacacttctgtgattcggacagtctaagcttctaagagtcttcgattctttccctctcgcagaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaacccgaggcctcttgtgcttccagaaccctccagttgttcacctttctgcactgaaaggcacttaagtgacactccaggagaaccttccccatctctggagaaggagctccctctgccatctgtgtaggttatgaaatgattgaggggaggccgggcgcagtggctcacgcctgtaatcccagcactttgggaggccgaggagggcggatcacttgagaccagaagttcaagaccagcctggccaacatggtgaaacctcatctctactaaaaatacaaaatttagccgggtgtggtggtgcatgcctgtaatcacagctactcgggaggctgaggcatgagagtcgcttgaatctgggagatggaggttgtagtgagccaag

SEQ ID NO: 287514 - DNA, 2274 bp, Homo sapiens
ggcataggagacaaaggaagctctcccctcccccgcgctctggcggcgacgggggtagcctgacccggaggacctggacgaaacagggcggagaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaacccgaggcctcttgtgcttccagaaccctccagttgttcacctttctgcactgaaaggcacttaagtgacactccaggagaaccttccccatctctggagaaggagctccctctgccatctgtgtaggttatgaaatgattgaggggaggccgggcgcagtggctcacgcctgtaatcccagcactttgggaggccgaggagggcggatcacttgagaccagaagttcaagaccagcctggccaacatggtgaaacctcatctctactaaaaatacaaaatttagccgggtgtggtggtgcatgcctgtaatcacagctactcgggaggctgaggcatgagagtcgcttgaatctgggagatggaggttgtagtgagccaag

SEQ ID NO: 287515 - DNA, 2105 bp, Homo sapiens
  misc_feature (2097)..(2097): n is a, c, g, or t
  misc_feature (2102)..(2102): n is a, c, g, or t
cgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgggattgcccgagaaaaaaaaggttaaaaaaaaaaagctgtngcggnagc

SEQ ID NO: 287516 - DNA, 2493 bp, Homo sapiens
cgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctaggtaagcaacgtgtatgaagatgctgcattggcccacagaaggcaaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaacccgaggcctcttgtgcttccagaaccctccagttgttcacctttctgcactgaaaggcacttaagtgacactccaggagaaccttccccatctctggagaaggagctccctctgccatctgtgtaggttatgaaatgattgaggggaggccgggcgcagtggctcacgcctgtaatcccagcactttgggaggccgaggagggcggatcacttgagaccagaagttcaagaccagcctggccaacatggtgaaacctcatctctactaaaaatacaaaatttagccgggtgtggtggtgcatgcctgtaatcacagctactcgggaggctgaggcatgagagtcgcttgaatctgggagatggaggttgtagtgagccaag

SEQ ID NO: 287517 - DNA, 2783 bp, Homo sapiens
cgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctaggaacagctatggaatggttaaagacatcattgcttttggctgtttacaagacggttccaattttggaattgtccccacctctgtggacagccattggctgggtccaaaggggccccaccccccctactcctgtcctccgggttctactgaagtgggcaaaatccccgagaagcagcggtgtccccagcctctcactcggagccgatatggggagtaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggtgagctgggaaggccgtaaggggcaaatggggacttggagtctggtgggggacagggctccagatggaactgttcatctcttgggaacaccctgacgcccccatctctgtacccacaggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaacccgaggcctcttgtgcttccagaaccctccagttgttcacctttctgcactgaaaggcacttaagtgacactccaggagaaccttccccatctctggagaaggagctccctctgccatctgtgtaggttatgaaatgattgaggggaggccgggcgcagtggctcacgcctgtaatcccagcactttgggaggccgaggagggcggatcacttgagaccagaagttcaagaccagcctggccaacatggtgaaacctcatctctactaaaaatacaaaatttagccgggtgtggtggtgcatgcctgtaatcacagctactcgggaggctgaggcatgagagtcgcttgaatctgggagatggaggttgtagtgagccaag

SEQ ID NO: 287518 - DNA, 2594 bp, Homo sapiens
cgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctaggaacagctatggaatggttaaagacatcattgcttttggctgtttacaagacggttccaattttggaattgtccccacctctgtggacagccattggctgggtccaaaggggccccaccccccctactcctgtcctccgggttctactgaagtgggcaaaatccccgagaagcagcggtgtccccagcctctcactcggagccgatatggggagtaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaaggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaacccgaggcctcttgtgcttccagaaccctccagttgttcacctttctgcactgaaaggcacttaagtgacactccaggagaaccttccccatctctggagaaggagctccctctgccatctgtgtaggttatgaaatgattgaggggaggccgggcgcagtggctcacgcctgtaatcccagcactttgggaggccgaggagggcggatcacttgagaccagaagttcaagaccagcctggccaacatggtgaaacctcatctctactaaaaatacaaaatttagccgggtgtggtggtgcatgcctgtaatcacagctactcgggaggctgaggcatgagagtcgcttgaatctgggagatggaggttgtagtgagccaag

SEQ ID NO: 287519 - DNA, 2200 bp, Homo sapiens
cgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctaggaacagctatggaatggttaaagacatcattgcttttggctgtttacaagacggttccaattttggaattgtccccacctctgtggacagccattggctgggtccaaaggggccccaccccccctactcctgtcctccgggttctactgaagtgggcaaaatccccgagaagcagcggtgtccccagcctctcactcggagccgatatggggagtaaaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaacccgaggcctcttgtgcttccagaaccctccagttgttcacctttctgcactgaaaggcacttaagtgacactccaggagaaccttccccatctctggagaaggagctccctctgccatctgtgtaggttatgaaatgattgaggggaggccgggcgcagtggctcacgcctgtaatcccagcactttgggaggccgaggagggcggatcacttgagaccagaagttcaagaccagcctggccaacatggtgaaacctcatctctactaaaaatacaaaatttagccgggtgtggtggtgcatgcctgtaatcacagctactcgggaggctgaggcatgagagtcgcttgaatctgggagatggaggttgtagtgagccaag

SEQ ID NO: 287520 - DNA, 2284 bp, Homo sapiens
cgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctaggaacagctatggaatggttaaagacatcattgcttttggctgtttacaagacggttccaattttggaattgtccccacctctgtggacagccattggctgggtccaaaggggccccaccccccctactcctgtcctccgggttctactgaagtgggcaaaatccccgagaagcagcggtgtccccagcctctcactcggagccgatatggggagtaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccacaggagtctttattacagtgtaaatccaagctcaggcctcccctggtcgacc

SEQ ID NO: 287521 - DNA, 2155 bp, Homo sapiens
cgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctaggaacagctatggaatggttaaagacatcattgcttttggctgtttacaagacggttccaattttggaattgtccccacctctgtggacagccattggctgggtccaaaggggccccaccccccctactcctgtcctccgggttctactgaagtgggcaaaatccccgagaagcagcggtgtccccagcctctcactcggagccgatatggggagtaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggtgagctgggaaggccgtaaggggcaaatggggacttggagtctggtgggggacagggctccagatggaactgttcatctcttgggaacaccctgacgcccccatctctgtacccacaggagtgattggtctattcaccatccccctgctgtaccggcagcaccaggtgagtgtgacaccctcagttgtcagcaccccagctaaacatgggggtctgaccatctccttccagaaccggggtcccattgacagatgtcccggccagacacaggtgtcctggctgcagcaccttcccaatacaaccagagtctaagtaacatgtcttatcagcatcagccagggacaggctttttgtttgtttttgttttgttttgggttttctttgagacggagtcatgccactgcactccaggctgggtgacagagcgagaccctgtctcaaaaaaataaatacaaataaataaataatttttta

SEQ ID NO: 287522 - DNA, 1947 bp, Homo sapiens
cgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaaggtggcctggagctctcagcccctcctgggttcccccattcacctctgcatggctagggggtgggagggcgactgttgggtaaattcacagcatgagagggaattcccggtgggctctgctgaccctgaccttcacccccagctggccctcctcttctacatcttgaccttcgtgggtgccatcttcaatggtttgactcttctcattctgggtgagctgggaaggccgtaaggggcaaatggggacttggagtctggtgggggacagggctccagatggaactgttcatctcttgggaacaccctgacgcccccatctctgtacccacaggagtgattggtctattcaccatccccctgctgtaccggcagcaccaggctcagatcgaccaatatgtggggttggtgaccaatcagttgagccacatcaaagctaagtaagagcatggggcggaggtcgatgggagggggaagtgggggagcttgggaacctttcctttctactctcgctgtccgcaaatctcctggggtaatgtccccttgaaaaggctgaggag

SEQ ID NO: 287523 - DNA, 4838 bp, Homo sapiens
ctcccacgggctggctggcaagcggccctggtgggtctgcgggggcaggggcagccttcctggtttatctccaccggcgcgatctgctcgtccgcctcggctccagaagctggggctcagggtccggcgaggcaggaagcctgaggccacagcccagagcagcctgagtgcagtcatgtgggggcgactgctcctgtggcccctggtgctggggttcagcctgtctggcggcacccagacccccagcgtctacgacgagagcgggagcaccggaggtggtgatgacagcacgccctcaatcctgcctgccccccgcggctacccaggccaagtctgtgccaatgacagtgacaccctggagctcccggacagctcacgggcactgcttctgggctgggtgcccaccaggctggtgcccgccctctatgggctggtcctggtggtggggctgccggccaatgggctggcgctgtgggtgctggccacgcaggcacctcggctgccctccaccatgctgctgatgaacctcgcgactgctgacctcctgctggccctggcgctgcccccgcggatcgcctaccacctgcgtggccagcgctggcccttcggggaggccgcctgccgcctggccacggccgcactctatggtcacatgtatggctcagtgctgctgctggccgccgtcagcctggatcgctacctggccctggtgcacccgctgcgggcccgcgccctgcgtggccggcgcctggcccttggactctgcatggctgcttggctcatggcggccgccctggcactgcccctgacactgcagcggcagaccttccggctggcgcgctccgatcgcgtgctctgccatgacgcgctgcccctggacgcacaggcctcccactggcaaccggccttcacctgcctggcgctgttgggctgtttcctgcccctgctggccatgctgctgtgctacggggccaccctgcacacgctggcggccagcggccggcgctacggccacgcgctgaggctgaccgcagtggtgctggcctccgccgtggccttcttcgtgcccagcaacctgctgctgctgctgcattactcggacccgagccccagcgcctggggcaacctctatggtgcctacgtgcccagcctggcgctgagcaccctcaacagctgcgtggatcccttcatctactactacgtgtcggccgagttcagggacaaggtgcgggcagggctcttccaacggtcgccgggggacaccgtggcctccaaggcctctgcggaagggggcagccggggcatgggcacccactcctctttgctccagtgacacaaagtggggaaggctgtactgggtcgaacagggtcccttcccccacttcacgtccttcctgggacctcagaatgtgaccttatttggaaatagggttgttacaactgtcactagcggaggtcactttggagaagggtgggccttacatccagtgtgggtggtgtcctcataagataaggagaggccaggcctggtggctcacgcctgtaatcccagcactttaagaggccaaggcggatggatcacttgagcccaggagttcaacaccagcctgagcaacatggtaaaaccccatctctaccaaaaatacaaaaattagctgggcttggtggctggcgcctgtaatcccagctactcaggagactgaggcagaaggatcgcttgaacctgggaggcagaggttgcagtgagccgagattgcgccactggactccagcctgcgtgacagagagcctgtctctaaattaattaattaattaatttaattcaattttaaaaagacgaaaagtgacggccaggtgcagtggctcacgcctataatctcagcactctgggaggccaagatggaggattgcttgaagccaggagtttgggaccagcctgggcaacatagggggatcccatctctacacacaaaaaaattttttaatgaaccaggcattgtggcatgcgcctatagtcccagccactcaagaggcacaggcgggaggatcacttgagcctgggaggttgtggttgcagtgagctatgattgtaccactgcactccagcctgggcaacagagcaagaccttgtctcaaaaataaacaaactaaaattaaaaaaagaagacgagagatagtgggtgtggtggctcacacctgcaatcccagcactttggaaggccgaggtgggcagatcatctgaggccaggagttcaagaccagcctggctaacatggtgaaatcctatctctaccaaaaatacaaaaattagccaggcgtggtggtgggcacctgtactggggaggtgcccacccagctactggggaggctgagtcaggagaatcgcttgaacctgggaggcggaggttgcggtcagctgagatggtgccactgcactccagcctgggcgaaagagcgactctgtctccaaaaaaaagagaagaggagaggacacagagacacacagagaagaaagccatgtggcggcagaggcagagatgggagtgatgcggacggacacaaactaagggatgccacgatgccaagcacagccaacagccaccagcagccaggagacaggcctgggacgggctctccctcacagcctccagagggaaccagccctgccaccaccttgaccctggacttctggcctgcagaactgtgagacaataaactctcattgttttaagctgcctggcatgtggcactttgtcagggcagcccaggaatctgaaacaggatcaaactctgcttcctgggccctgccagcatctctggctcggctttctgggctggatgcagcccacgacgcactggtgtctgagatggggctggagctggggctggggctgcattccctggagactcactgcaagttcctgcccaggaggctgagggcaccccatcctcagtgcccaatgctgtggccccaccaggcccagagcctggttggccattctcatgcccaccagcttctggctttgggatgtctcttgagcaaccagaatagcacccccaactctgctccccaaaacccatcactagcacggctcagcctcctgctatcccctgactgctggggaccctcgccttccctcctctcacctgcaggctgatccttcttttcactttctgtcaatgtcaccagggataaggtgggacaatggggggtgggggtggacagtgtgtgctggggggttcgggtgctgcagacctggaactcccttctgccaggatgttggcagccggttgtaagccttgcacgggacagaccacacccaccgcaacctcatcccctcagcactaaccacatccactctcaaccccgtccccttcgcactgaccacacccaccccgttcggccccgccccccgcactgaacactcccgccctcaaccccgcaccctccgcactcacctccccctcgccgctcgaccccgccctcaccacactgaccaccctcaacccattgcgcccagtccccaccacagtgaccacaccctcactggctcggccctgcccccagtatactgaccattccccagccacttcccttccgcacttaccactcccccagccacgcccctccccgctgaccgctcctccagccccgcctcccccgtacaggcagagcgcccgcccacctctatgctgcgttctcctgactttacgttggcccctcctctgccaagcccccaggggagccctccctggcgtccgagggtgggagtcggggtgtggcaggccgcggtggggggcggcagtggctccgcgcactcacccgggccccgggcaggggcgcgctccacttcgttgcacgcgggtccggcgcacagttcccgggcgagtgggctgtgcgtgctgacgttgtagaagcgagtggcctcgaaggctacgggacgagggtggcgggtgaccaagtgcaggcgcgacgggtcagggaccgggccgggccgggggtgcgggcgcgcgggcctaccgggttcgtagtagtcgtacacggagactggcagcgccgacgtcctgcccaccacgcactcccggagagcacggaaccgcacgcacgtcaggcaccggctggggatctgtggggcagcggcgggcgcaggctcgacccgggccaggaggcccggggcgctgagctcaggcccagaactggctgatttcagggatacccaggacgcgtgaaacacagaagaaacgtgatcccattttctttttttcttttacttttctttttttttttttttcctgagacagagtctcgcgctgttgcccaggctggagtgcagtggcgtgatctcggctcactgcaagctcggcctcctgggttcaaatgattctcctgcctcagcctcccaagtagctgggataacaggcgcccaccaccgcaccctgctaattttttgtatttttgatcaagacggagtttcaccatgttggccaggctggtctccaactcctgccctcaagtgatccgcctcggtcccattttttattctttgggtccttccatcccactgggaaaacgtctcaggtggcctctgaaacaccactcctttttgtgtgtgtgcacgcatggctgagcatgtgtgggtgggagtcagcacattcacgatactgtgcaatcatcacctctgtctagttacaggacggtttctttctcccccaaagaaaccccatcgccatcagcactcactccccactcccccagcccctggcaaccacaaatctttccaactctacggatttgcctgttctgggcatttcatgtcaatggaatcatgtactctgtg

SEQ ID NO: 287524 - DNA, 2568 bp, Homo sapiens
ctcccacgggctggctggcaagcggccctggtgggtctgcgggggcaggggcagccttcctggtttatctccaccggcgcgatctgctcgtccgcctcggctccagaagctggggctcagggtccggcgaggcaggaagcctgaggccacagcccagagcagcctgagtgcagtcatgtgggggcgactgctcctgtggcccctggtgctggggttcagcctgtctggcggcacccagacccccagcgtctacgacgagagcgggagcaccggaggtggtgatgacagcacgccctcaatcctgcctgccccccgcggctacccaggccaagtctgtgccaatgacagtgacaccctggagctcccggacagctcacgggcactgcttctgggctgggtgcccaccaggctggtgcccgccctctatgggctggtcctggtggtggggctgccggccaatgggctggcgctgtgggtgctggccacgcaggcacctcggctgccctccaccatgctgctgatgaacctcgcgactgctgacctcctgctggccctggcgctgcccccgcggatcgcctaccacctgcgtggccagcgctggcccttcggggaggccgcctgccgcctggccacggccgcactctatggtcacatgtatggctcagtgctgctgctggccgccgtcagcctggatcgctacctggccctggtgcacccgctgcgggcccgcgccctgcgtggccggcgcctggcccttggactctgcatggctgcttggctcatggcggccgccctggcactgcccctgacactgcagcggcagaccttccggctggcgcgctccgatcgcgtgctctgccatgacgcgctgcccctggacgcacaggcctcccactggcaaccggccttcacctgcctggcgctgttgggctgtttcctgcccctgctggccatgctgctgtgctacggggccaccctgcacacgctggcggccagcggccggcgctacggccacgcgctgaggctgaccgcagtggtgctggcctccgccgtggccttcttcgtgcccagcaacctgctgctgctgctgcattactcggacccgagccccagcgcctggggcaacctctatggtgcctacgtgcccagcctggcgctgagcaccctcaacagctgcgtggatcccttcatctactactacgtgtcggccgagttcagggacaaggtgcgggcagggctcttccaacggtcgccgggggacaccgtggcctccaaggcctctgcggaagggggcagccggggcatgggcacccactcctctttgctccagtgacacaaagtggggaaggctgtactgggtcgaacagggtcccttcccccacttcacgtccttcctgggacctcagaatgtgaccttatttggaaatagggttgttacaactgtcactagcggaggtcactttggagaagggtgggccttacatccagtgtgggtggtgtcctcataagataaggagaggccaggcctggtggctcacgcctgtaatcccagcactttaagaggccaaggcggatggatcacttgagcccaggagttcaacaccagcctgagcaacatggtaaaaccccatctctaccaaaaatacaaaaattagctgggcttggtggctggcgcctgtaatcccagctactcaggagactgaggcagaaggatcgcttgaacctgggaggcagaggttgcagtgagccgagattgcgccactggactccagcctgcgtgacagagagcctgtctctaaattaattaattaattaatttaattcaattttaaaaagacgaaaagtgacggccaggtgcagtggctcacgcctataatctcagcactctgggaggccaagatggaggattgcttgaagccaggagtttgggaccagcctgggcaacatagggggatcccatctctacacacaaaaaaattttttaatgaaccaggcattgtggcatgcgcctatagtcccagccactcaagaggcacaggcgggaggatcacttgagcctgggaggttgtggttgcagtgagctatgattgtaccactgcactccagcctgggcaacagagcaagaccttgtctcaaaaataaacaaactaaaattaaaaaaagaagacgagagatagtgggtgtggtggctcacacctgcaatcccagcactttggaaggccgaggtgggcagatcatctgaggccaggagttcaagaccagcctggctaacatggtgaaatcctatctctaccaaaaatacaaaaaaaaaaaagagaagaggagaggacacagagacacacagagaagaaagccatgtggcggcagaggcagagatgggagtgatgcggacggacacaaactaagggatgccacgatgccaagcacagccaacagccaccagcagccaggagacaggcctgggacgggctctccctcacagcctccagagggaaccagccctgccaccaccttgaccctggacttctggcctgcagaactgtgagacaataaactctcattgtttta

SEQ ID NO: 287525 - DNA, 973 bp, Homo sapiens
ctcccacgggctggctggcaagcggccctggtgggtctgcgggggcaggggcagccttcctggtttatctccaccggcgcgatctgctcgtccgcctcggctccagaagctggggctcagggtccggcgaggcaggaagcctgaggccacagcccagagcagcctgagtgcagtcatgtgggggcgactgctcctgtggcccctggtgctggggttcagcctgtctggcggcacccagacccccagcgtctacgacgagagcgggagcaccggaggtggtgatgacagcacgccctcaatcctgcctgccccccgcggctacccaggccaagtctgtgccaatgacagtgacaccctggagctcccggacagctcacgggcactgcttctgggctgggtgcccaccaggctggtgcccgccctctatgggctggtcctggtggtggggctgccggccaatgggctggcgctgtgggtgctggccacgcaggcacctcggctgccctccaccatgctgctgatgaacctcgcgactgctgacctcctgctggccctggcgctgcccccgcggatcgcctaccacctgcgtggccagcgctggcccttcggggaggccgcctgccgcctggccacggccgcactctatggtcacatgtatggctcagtgctgctgctggccgccgtcagcctggatcgctacctggccctgctggccatgctgctgtgctacggggccaccctgcacacgctggcggccagcggccggcgctacggccacgcgctgaggctgaccgcagtggtgctggcctccgccgtggccttcttcaagcacagccaacagccaccagcagccaggagacaggcctgggacgggctctccctcacagcctccagagggaaccagccctgccaccaccttgaccctggacttctggcctgcagaactgtgagacaataaactctcattgtttta

SEQ ID NO: 287526 - DNA, 2245 bp, Homo sapiens
gaccctgtttctctagccgtgcagctgcaaggtcactagacagaaaaactcaagtcataaacatgttttttcttgaaagggcagtagtcagaaaagaaaggaactgatcttggacttgaagaaacagccccagaggtgaaagagatagtcgttaacctgcacagcctctttccagcctcttcacagataacaagggctttcggaacaagaaacttgtatattctgtgcagctcaaataaaattaagaagctgaacatcagttgacaaagagtaaaaaataactgggagttgacgggaaaataaactgtcgtttatgaaaatgtagcttattccagaacaccagatttcaaaagatacagaatcctgttgctccacaattcaatttgtcctacaaaaagcaaatatagtaaatagaagttgccaacactgaagagaagattaacaaatctgagcatcccaatggagcagacaacatgttcagaccatccaaagatccaaatggcaggtttgatcactccaattgacaccaggtacaagccaggtaatgtagtaatcatgggatcccactttaaaatgaaagaaaatgaagtaaaagcaagaggtaataggaacaagacaggcacaaatatgtcaagcccaagtctcatctccagcaacaatcagaaattttgagaagttattctatgacaagattaagtaagtccttggcagaacaggattcgtttttcctattttttgcccccggaccagcttagtgatggttcaggtagcagcaaccaataaacaacaacaacttaaaatctatttctattttccaagaaatgttctttaaaagcctttattttgataaataaactgcaaatgttccagtttttaaaagcatggaaacattgtttgggactcttaagtttaggaaaacatttggaccacaggctccatgatgacagctaacataaactgagacagaaattgttgccaaaccctctgtattaacgttacaatatgccctatagtaaagattattgtcattttgcagatgagtaacctgaatttctgaaactcagaacatctccaagatcacaaaactagtaaatcacagcaccaagatttaagatcagatctttctctaaaacagactttatatttctagccagtaccctatattgtgtcaccagagaagcaggggatgcttattttgatatttatatgtacatacttgcacagtcaaatatatactcaaaaatgatgtgacttgactggttgccagtttatccagttaacagttcactaaaaatacccagggaaggaatttgtgattataaattgtcactttttggtagctgaagatccctccagtccaccctatcccacccctaaaatgcacagtgaggtgcttgacaggtgagctaaaggaaagttttctggtatttccaaggagcacccgaatgcctttaatcctaaaacaaggaaagacaaagtgggatcgatatcgtcagctgccaagaggagggctcagttccccgttgagtattctcccagatcactccttcctggaggacagatctgctgtttattcattcatttaataaatatttcacagatctcagagacaggaacaaaagactatacccagtttctttcatgttctgaggcttgagggggtggaacaggacgagtgaagtctaaggatgggaggacgtggggacgctgggacctctcaggcctctcctggggtggggacaggttggggaccccacctgggaaagggagaaatggccctcacagtagcgctgcgcctgaggcaggtggaagatctcgtccatgtagggctctcgcaacgcccggctgaaggcggagaagaggaggcaggatactaaaaaggtagctcaaggcggccgagaaatagtaaccttccagctgcgccattccagctcccacagccactgcccaagaacctactcctggaaaattctgagcctggaaacccgagctggaaacttgggctcgaaatgggcgcgctaggcgggactagccagacggggccacataccggaaggcaaaggatgctgggagagcgcggatccggaaagatcgggtcgctgtttcccggagtgacgggtttagataacggaccggatgattaccctctcaatcgcattgcccggggcgcacaaagtgtcaaaacttccggaaggggcgggtctcggatttcgccagcgcgggaggtgcgtggcttgctgcttag

SEQ ID NO: 287527 - DNA, 543 bp, Homo sapiens
agcgtcggagtctacgaggaaaataaacagctggaaataagcagactagtgtaagagtgaattgaaaagaaaacccaaggtcacatctcccaagaagcagtaatgttccagcaataagaaaaggacagttttttgtcttttgcatggtgagccttatatgaattacatcaattttgtcaccaatatccatcatcagaacattttgattctacataacacattgcaaatggtcacagcaatcaagactatatccatagatgtcccagaaataatatctgactatacagagcagcattaccaagccaccaagaagtctgcctagtaatgacaatgataacaacagctaacacttatcaacagagcagaggaacagagccacagataactgaaaaccactttggcactgaggaggtatgcagacaagatctggaagggaatctagaaaaatggcaactttggaataatagataccttttgttttcttatcgcttttatttttgtcatgataaatattaagagtaaaaagaaaattcacattgtttg

SEQ ID NO: 287528 - DNA, 762 bp, Homo sapiens
cgtcttgacgggctgctcccctcctttcctcccgccacaagcgctcgctgtggttctggcagcgaagtgcgagactgggctcgccaggcggaagtggttggagactgcgtgttttcctagaaagtcctcgaccttcgtcggggagaggaggggagtgataaattggaaggcggacaagcgacaagtgcggtactggaaagacccaaacatacttggttgtgacctcagaaaataaacagctggaaataagcagactagtgtaagagtgaattgaaaagaaaacccaaggtcacatctcccaagaagcagtaatgttccagcaataagaaaaggacagttttttgtcttttgcatggtgagccttatatgaattacatcaattttgtcaccaatatccatcatcagaacattttgcctactcactgtgaagacaataaggatgaagacctttatgacaatccacttccacttaatgaataatgaggaaactggggcacagagaaattaagtgacttgtccaggaggacagggccaataaccggtggaaccataagaaaaaaatccagtaacagctttgaaaaaggaagataacaatgacctgtgtgtacagcgtccaagggaaccattagcagtggagctccccaggctcctgggacgaccaagcacatggtccaaccaaccatcttctgacaaggtaggggtgggcagtggaaggcaaaaagaatggctgcacttgtgtttctgaaggtcagaccaagaaac

SEQ ID NO: 287529 - DNA, 2246 bp, Homo sapiens
ttttccattagaagctgaagttttattataggataacagtacataaagcacatctaaaattgatgtgttcaatgcacttttaataaaggtaatgtaatattaaaggtacagtttctaagtacaatataacaacattcatattagaatgaaaattggagtatttaaaagacaacattaaatctctcttttttgtacagcttgtatttacaaaatgaatcaaaatattttttttttaaattcaggactcaataaaataaacagctggaaataagcagactagtgtaagagtgaattgaaaagaaaacccaaggtaagtgaaaagttggacgatcctctaataaagatcattagcaaagttttagttcaatactagttttaggattcccataaatggcttgcatttttagtgtggcagaaaaggagtttttacatactgtacacaaaacagacagcatatatttataggtacagtattactgtttccaaacttgcatgtatatttacagaaggctgagtttgtttactcaaacagaagtttgtgaaatttgtgtgcttaatcctcaagacctacacacaattagaatcagcatttcatgtggtctttttaaatgtggctttaatacttggttgtagaggagaatgttaaccgtaaggcttggcttactttgtaaatttaacaaaacaacccaggaaaaacgttttaattggggcacacttgttatcatttaacaattgtcaaatgctgacatgtgctagccattgtgcagacgcaaaaagatacaatctctaccctcaggaagcttaggatgctaaatcgtgctttaaaaaaaaggtttcaatctctttccaagagaggcagttaaggaatgatgtgatttatattaaaagagatttctccctcaactgtagccaatccactttaaaaggttaactactagcattagctctcattaaccacacaattgcatttataattaaggtaacagcaactcttccacaaaaatggaaaatgtctagaattgtggataaatattgcagtgcatggaagccaataatcatggcttgagaatttatcaccttcagttacaaaaagtgcagtaaacagaaacatttgctctacatttataaattgctcaaaaatctttgctaaagatcttacaaattcagtaatattacagaacaattctaatcaatatttaataaggttaactacatccttagttagatatttgataaactttgcttttcaataatgccaatagatcttgggagaatgggtagaaaggcttaattaagctacttattaaataactttgaaaatgaaggtccttcactcagttcatggaactggttgaggtcatactgaaacagaacatcccatgtcgaatttgctttatggcccatgttatggcagaggacgtctccatccttctcatgactcaggtaggaggggaaaggtttattctgccatcaagccatctaggatattttatgtaaatgcccattatctataataggagctaagaatacaactgtgttaggtgccagtaatacaattccttaataagaaaaaaaagtatattactccattaaacaagtttctttaggatcttgaaggcctggcaaattatttttcagcttaggagatatgctgtaaagccaagtagcaaacataaagtaaatgctaataagtttccatatagccatatttataaacaaattcaccctatagatgtcaaatatccatactaaggaagtaattttatcctaattaaatacactctagaataatttatataatgatattatgtatttaaagagaaaagcatgtcccaaatccagcactctgatacagctgccagttgggcataggtgagatatatatatatatgtatatatatacaaatatatagttatactcagtgaaattaacaagacccaaaggtggtattgtctaggaataaaagggataatttttgttgttcacaaaagtaacttgtctagcaccacacatcagaaaaacacaaaaatagcacactctagttctaaacagctatgtctaaaatagattatatagtaaaaccggtattatacagcatattgtggatttgataaacagataaatatttgcactgagtaggctgtttataatataacattttcttatctatacagaatgaaagccaaaaagttaactgtatagagatgtgcagaacaacattaaatattatgactcaaaagcaggg

SEQ ID NO: 287530 - DNA, 2192 bp, Homo sapiens
ttttccattagaagctgaagttttattataggataacagtacataaagcacatctaaaattgatgtgttcaatgcacttttaataaaggtaatgtaatattaaaggtacagtttctaagtacaatataacaacattcatattagaatgaaaattggagtatttaaaagacaacattaaatctctcttttttgtacagcttgtatttacaaaatgaatcaaaatattttttttttaaattcaggactcaataaaataaacagctggaaataagcagactagtgtaagagtgaattgaaaagaaaacccaaggtaagtgaaaagttggacgatcctctaataaagatcattagcaaagttttagttcaatactagttttaggattcccataaatggcttgcatttttagtgtggcagaaaaggagtttttacatactgtacacaaaacagacagcatatatttataggtacagtattactgtttccaaacttgcatgtatatttacagaaggctgagtttgtttactcaaacagaagtttgtgaaatttgtgttaaatgtggctttaatacttggttgtagaggagaatgttaaccgtaaggcttggcttactttgtaaatttaacaaaacaacccaggaaaaacgttttaattggggcacacttgttatcatttaacaattgtcaaatgctgacatgtgctagccattgtgcagacgcaaaaagatacaatctctaccctcaggaagcttaggatgctaaatcgtgctttaaaaaaaaggtttcaatctctttccaagagaggcagttaaggaatgatgtgatttatattaaaagagatttctccctcaactgtagccaatccactttaaaaggttaactactagcattagctctcattaaccacacaattgcatttataattaaggtaacagcaactcttccacaaaaatggaaaatgtctagaattgtggataaatattgcagtgcatggaagccaataatcatggcttgagaatttatcaccttcagttacaaaaagtgcagtaaacagaaacatttgctctacatttataaattgctcaaaaatctttgctaaagatcttacaaattcagtaatattacagaacaattctaatcaatatttaataaggttaactacatccttagttagatatttgataaactttgcttttcaataatgccaatagatcttgggagaatgggtagaaaggcttaattaagctacttattaaataactttgaaaatgaaggtccttcactcagttcatggaactggttgaggtcatactgaaacagaacatcccatgtcgaatttgctttatggcccatgttatggcagaggacgtctccatccttctcatgactcaggtaggaggggaaaggtttattctgccatcaagccatctaggatattttatgtaaatgcccattatctataataggagctaagaatacaactgtgttaggtgccagtaatacaattccttaataagaaaaaaaagtatattactccattaaacaagtttctttaggatcttgaaggcctggcaaattatttttcagcttaggagatatgctgtaaagccaagtagcaaacataaagtaaatgctaataagtttccatatagccatatttataaacaaattcaccctatagatgtcaaatatccatactaaggaagtaattttatcctaattaaatacactctagaataatttatataatgatattatgtatttaaagagaaaagcatgtcccaaatccagcactctgatacagctgccagttgggcataggtgagatatatatatatatgtatatatatacaaatatatagttatactcagtgaaattaacaagacccaaaggtggtattgtctaggaataaaagggataatttttgttgttcacaaaagtaacttgtctagcaccacacatcagaaaaacacaaaaatagcacactctagttctaaacagctatgtctaaaatagattatatagtaaaaccggtattatacagcatattgtggatttgataaacagataaatatttgcactgagtaggctgtttataatataacattttcttatctatacagaatgaaagccaaaaagttaactgtatagagatgtgcagaacaacattaaatattatgactcaaaagcaggg

SEQ ID NO: 287531 - DNA, 1110 bp, Homo sapiens
  misc_feature (1092)..(1092): n is a, c, g, or t
ttttccattagaagctgaagttttattataggataacagtacataaagcacatctaaaattgatgtgttcaatgcacttttaataaaggtaatgtaatattaaaggtacagtttctaagtacaatataacaacattcatattagaatgaaaattggagtatttaaaagacaacattaaatctctcttttttgtacagcttgtatttacaaaatgaatcaaaatattttttttttaaattcaggactcaataaaataaacagctggaaataagcagactagtgtaagagtgaattgaaaagaaaacccaaggtaagtgaaaagttggacgatcctctaataaagatcattagcaaagttttagttcaatactagttttaggattcccataaatggcttgcatttttagtgtggcagaaaaggagtttttacatactgtacacaaaacagacagcatatatttataggtacagtattactgtttccaaacttgcatgtatatttacagaaggctgagtttgtttactcaaacagaagtttgtgaaatttgtgtgcttaatcctcaagacctacacacaattagaatcagcatttcatgtggtctttttaaatgtggctttaatacttggttgtagaggagaatgttaaccgtaaggcttggcttactttgtaaatttaacaaaacaacccaggaaaaacgttttaattggggcacacttgttatcatttaacaattgtcaaatgctgacatgtgctagccattgtgcagacgcaaaaagatacaatctctaccctcaggaagcttaggatgctaaatcgtgctttaaaaaaaaggtttcaatctctttccaagagaggcagttaaggaatgatgtgatttatattaaaagagatttctccctcaactgtagccaatccactttaaaaggttaactactagcattagctctcattaaccacacaattgcatttataattaaggtaacagcaactcttccacaaaaatggaaaatgtctagaattgtggataaatattgcagtgcatggaagccaataatcatggcttgagaatctcgtgccgaattcctgcagcncggggatcgcactagttc

SEQ ID NO: 287532 - DNA, 2178 bp, Homo sapiens
ttttccattagaagctgaagttttattataggataacagtacataaagcacatctaaaattgatgtgttcaatgcacttttaataaaggtaatgtaatattaaaggtacagtttctaagtacaatataacaacattcatattagaatgaaaattggagtatttaaaagacaacattaaatctaaaataaacagctggaaataagcagactagtgtaagagtgaattgaaaagaaaacccaaggtaagtgaaaagttggacgatcctctaataaagatcattagcaaagttttagttcaatactagttttaggattcccataaatggcttgcatttttagtgtggcagaaaaggagtttttacatactgtacacaaaacagacagcatatatttataggtacagtattactgtttccaaacttgcatgtatatttacagaaggctgagtttgtttactcaaacagaagtttgtgaaatttgtgtgcttaatcctcaagacctacacacaattagaatcagcatttcatgtggtctttttaaatgtggctttaatacttggttgtagaggagaatgttaaccgtaaggcttggcttactttgtaaatttaacaaaacaacccaggaaaaacgttttaattggggcacacttgttatcatttaacaattgtcaaatgctgacatgtgctagccattgtgcagacgcaaaaagatacaatctctaccctcaggaagcttaggatgctaaatcgtgctttaaaaaaaaggtttcaatctctttccaagagaggcagttaaggaatgatgtgatttatattaaaagagatttctccctcaactgtagccaatccactttaaaaggttaactactagcattagctctcattaaccacacaattgcatttataattaaggtaacagcaactcttccacaaaaatggaaaatgtctagaattgtggataaatattgcagtgcatggaagccaataatcatggcttgagaatttatcaccttcagttacaaaaagtgcagtaaacagaaacatttgctctacatttataaattgctcaaaaatctttgctaaagatcttacaaattcagtaatattacagaacaattctaatcaatatttaataaggttaactacatccttagttagatatttgataaactttgcttttcaataatgccaatagatcttgggagaatgggtagaaaggcttaattaagctacttattaaataactttgaaaatgaaggtccttcactcagttcatggaactggttgaggtcatactgaaacagaacatcccatgtcgaatttgctttatggcccatgttatggcagaggacgtctccatccttctcatgactcaggtaggaggggaaaggtttattctgccatcaagccatctaggatattttatgtaaatgcccattatctataataggagctaagaatacaactgtgttaggtgccagtaatacaattccttaataagaaaaaaaagtatattactccattaaacaagtttctttaggatcttgaaggcctggcaaattatttttcagcttaggagatatgctgtaaagccaagtagcaaacataaagtaaatgctaataagtttccatatagccatatttataaacaaattcaccctatagatgtcaaatatccatactaaggaagtaattttatcctaattaaatacactctagaataatttatataatgatattatgtatttaaagagaaaagcatgtcccaaatccagcactctgatacagctgccagttgggcataggtgagatatatatatatatgtatatatatacaaatatatagttatactcagtgaaattaacaagacccaaaggtggtattgtctaggaataaaagggataatttttgttgttcacaaaagtaacttgtctagcaccacacatcagaaaaacacaaaaatagcacactctagttctaaacagctatgtctaaaatagattatatagtaaaaccggtattatacagcatattgtggatttgataaacagataaatatttgcactgagtaggctgtttataatataacattttcttatctatacagaatgaaagccaaaaagttaactgtatagagatgtgcagaacaacattaaatattatgactcaaaagcaggg

SEQ ID NO: 287533 - DNA, 774 bp, Homo sapiens
ttttccattagaagctgaagttttattataggataacagtacataaagcacatctaaaattgatgtgttcaatgcacttttaataaaggtaatgtaatattaaaggtacagtttctaagtacaatataacaacattcatattagaatgaaaattggagtatttaaaagacaacattaaatctctcttttttgtacagcttgtatttacaaaatgaatcaaaatattttttttttaaattcaggactcaataaaataaacagctggaaataagcagactagtgtaagagtgaattgaaaagaaaacccaaggtcacatctcccaagaagcagtaatgttccagcaataagaaaaggacagttttttgtcttttgcatggtgagccttatatgaattacatcaattttgtcaccaatatccatcatcagaacattttgattctacataacacattgcaaatggtcacagcaatcaagactatatccatagatgtcccagaaataatatctgactatacagagcagcattaccaagccaccaagaagtctgcctagtaatgacaatgataacaacagctaacacttatcaacagagcagaggaacagagccacagataactgaaaaccactttggcactgaggaggtatgcagacaagatctggaagggaatctagaaaaatggcaactttggaataatagataccttttgttttcttatcgcttttatttttgtcatgataaatattaagagtaaaaagaaaattcacattgtttg

SEQ ID NO: 287534 - DNA, 1031 bp, Homo sapiens
ttttccattagaagctgaagttttattataggataacagtacataaagcacatctaaaattgatgtgttcaatgcacttttaataaaggtaatgtaatattaaaggtacagtttctaagtacaatataacaacattcatattagaatgaaaattggagtatttaaaagacaacattaaatctctcttttttgtacagcttgtatttacaaaatgaatcaaaatattttttttttaaattcaggactcaataaaataaacagctggaaataagcagactagtgtaagagtgaattgaaaagaaaacccaaggtcacatctcccaagaagcagtaatgttccagcaataagaaaaggacagttttttgtcttttgcatggtgagccttatatgaattacatcaattttgtcaccaatatccatcatcagaacattttgattctacataacacattgcaaatggtcacagcaatcaagactatatccatagatgtcccagaaataatatctgactatacagagcagcattaccaagccaccaagaagtctgcctagtaatgacaatgataacaacagctaacacttaggatttgatttaggacaaattgttatttggatggatgcttgtctattgagagagtaattgttaaactaaaggaaactggtcacaaatactttagcaatggctataaatgaccagtgggccaaggattttgagatcgtgagagacttctccgggaatgttgtcattcatttcactccagtgtggctcttttcctccatctgcgctcacttttctaggagaactatggccactatggagaatatgaaaacattgctgaaggaggtgaaagccatttcagaagaagagttatatattagcttttggcagtgacagcgttatgggcacggacattcagcctttccagttgactgctttgaaggggcaatgttcacgtggaagtatacctcctagtacgtttgctaaaataaaatcagcttcattacctaataacataaatgactttgggag

SEQ ID NO: 287535 - DNA, 672 bp, Homo sapiens
gtagagacagagtcttggtgtgttgctcaggctggtcttgaactcttgtgctcacatcttcctctcaactcagcctcccaaactgctggggctacaggtgtgagccactgtgcccagcctatatgtgcttcttatgtatatcatagattgtggccttactctatattagttcttgcattgctatttagctttccctacacaggcctcatctctacaactagaccataaactgcttgagggaaagatgtggtcttctatgtctttggatcccttacagtgcttacatagtgcttggtcccaagggagtgctcatagtattcttttttattggcagattctacataacacattgcaaatggtcacagcaatcaagactatatccatagatgtcccagaaataatatctgactatacagagcagcattaccaagccaccaagaagtctgcctagtaatgacaatgataacaacagctaacacttatcaacagagcagaggaacagagccacagataactgaaaaccactttggcactgaggaggtatgcagacaagatctggaagggaatctagaaaaatggcaactttggaataatagataccttttgttttcttatcgcttttatttttgtcatgataaatattaagagtaaaaagaaaattcacattgtttg

SEQ ID NO: 287536 - DNA, 1056 bp, Homo sapiens
cgtcttgacgggctgctcccctcctttcctcccgccacaagcgctcgctgtggttctggcagcgaagtgcgagactgggctcgccaggcggaagtggttggagactgcgtgttttcctagaaagtcctcgaccttcgtcggggagaggaggggagtgataaattggaaggcggacaagcgacaagtgcggtactggaaagacccaaacatacttggttgtgacctcagaaaataaacagctggaaataagcagactagtgtaagagtgaattgaaaagaaaacccaaggtcacatctcccaagaagcagtaatgttccagcaataagaaaaggacagttttttgtcttttgcatggtgagccttatatgaattacatcaattttgtcaccaatatccatcatcagaacattttgtggcactgtggctcgaaccaatgtccagcttccacactatctgcttggaagaggattacccttatttggaagtctcagttttgaggatttggggaaagcaggcacgcaagcagatacaccttattctctacagcatcatttatacctcaactaagtcagctgaacaaatgcctgctgaaaagttctgggagtggcatagctaagaaccagaaaggcgatctttcttttggattaagtcaacagagtcatacccacaaggagaactatcaaatatcagatgcgagaggtgaagtgcggttataagattctacataacacattgcaaatggtcacagcaatcaagactatatccatagatgtcccagaaataatatctgactatacagagcagcattaccaagccaccaagaagtctgcctagtaatgacaatgataacaacagctaacacttatcaacagagcagaggaacagagccacagataactgaaaaccactttggcactgaggaggtatgcagacaagatctggaagggaatctagaaaaatggcaactttggaataatagataccttttgttttcttatcgcttttatttttgtcatgataaatattaagagtaaaaagaaaattcacattgtttg

SEQ ID NO: 287537 - DNA, 1504 bp, Homo sapiens
agttcccagctgtccgaaaggtcttcggaacttcggctctaaagcgttcctcagcgccatccgcccggaaacacgagcgacagagaaaaggtccgcgaggccggcagactccagagtggctgggtccgagcgcggggcgggttgccgaagggcctcggcctgggctgcgtgctggagagcggggacggggccgactcaccagaggctgcagcaacaggtccactttgctctccagtctctttctccgacaccgctgaggcggtttcccaccgacttcctttccatacagcaccggcaggcaccggggtgaagggtcataaaaatggcgctggccgctcgtttgctaccccagttcctgcactctcggtcgctgccctgcggggccgtccgactccggactcctgctgtggccgaggtgaggctgccgtcggccacactttgctacttctgccgctgtcgcctcggcttgggagcggcgttatttccacgaagcgctagggccttggcagcctcggcgctacctgcccagggctcccggtggccagtgctcagcagcccgggactccccgcagccttcgcttctttccctgcctgccctcagcgcagctacagcacggaggagaagccccagcagcaccagaaaaccaagatgatcgtcctgggattctccaaccccatcaactgggttaggactcgaattaaggccttccttatctgggcctatttcgacaaagagttcagcatcacagagttctccgagggagcgaagcaggcttttgctcatgtatccaagttgctgtcacagtgtaaatttgatctgttggaagaacttgtggccaaagaggtgctacatgcattgaaagaaaaggttacttcactacctgacaaccataaaaatgcccttgctgctaacatagatgaaattgtatttacatcaacaggagacatctccatttactatgatgagaaaggaaggaagtttgttaacatcctgatgtgcttttggtatctaaccagtgccaacatccccagtgaaactttaagaggagccagtgtattccaggttaagttggggaatcagaatgtggaaactaaacaacttcttagtgcaagctatgagtttcagagggagttcacacaaggagtaaagcctgactggaccattgcacggattgaacactcaaaattattagaataattttcttggaaaaatcagcttatggactttagcagttgctgtgaaaaactaaggaagaaaaattttggggtcatttgatcttcacttaatctaagtctgtgaattacttttatattattttgaaatactccttgcagtatattggcatgatacagtaaaagcattttccacagattgttatcaccttctttaaaagaagtcaaaatttaaaaaatacaatagcacgttgttggtgtcatattcaataacatttccaatgctacatataattttatagacataataaagaaggtattgaaaaaacta

SEQ ID NO: 287538 - DNA, 702 bp, Homo sapiens
ttgtggtcaatcgacgtggtacctgcattgatcgaaaaggtaactcccaactagctgaccagaacataaaaatgccctggtcatgatacacataacatcaaagtggccactaaagcttgcaagcgagcgccaacatctccattaactatctatgacgagaaggcacagtgaaggaagtttgttaacatcctgatgtgcttttggtatctaaccagtgccaacatccccagtgaaactttaagaggagccagtgtattccaggttaagttggggaatcagaatgtggaaactaaacaacttcttagtgcaagctatgagtttcagagggagttcacacaaggagtaaagcctgactggaccattgcacggattgaacactcaaaattattagaataattttcttggaaaaatcagcttatggactttagcagttgctgtgaaaaactaaggaagaaaaattttggggtcatttgatcttcacttaatctaagtctgtgaattacttttatattattttgaaatactccttgcagtatattggcatgatacagtaaaagcattttccacagattgttatcaccttctttaaaagaagtcaaaatttaaaaaatacaatagcacgttgttggtgtcatattcaataacatttccaatgctacatataattttatagacataataaagaaggtattgaaaaaacta

SEQ ID NO: 287539 - DNA, 285 bp, Homo sapiens
gctttctagaggatcccagctatgcagtttcagagggagttcacacaaggagtaaagcctgactggaccattgcacggattgaacactcaaaattattagaataattttcttggaaaaatcagcttatggactttagcagttgctgtgaaaaactaaggaagaaaaattttggggtcatttgatcttcacttaatctaagtctgtgaattacttttatattattttgaaatactccttgcagtatattggcatgaaaggcctcgacatgaagggtaccgagctcg

SEQ ID NO: 287540 - DNA, 1525 bp, Homo sapiens
agttcccagctgtccgaaaggtcttcggaacttcggctctaaagcgttcctcagcgccatccgcccggaaacacgagcgacagagaaaaggtccgcgaggccggcagactccagagtggctgggtccgagcgcggggcgggttgccgaagggcctcggcctgggctgcgtgctggagagcggggacggggccgactcaccagaggctgcagcaacaggtccactttgctctccagtctctttctccgacaccgctgaggcggtttcccaccgacttcctttccatacagcaccggcaggcaccggggtgaagggtcataaaaatggcgctggccgctcgtttgctaccccagttcctgcactctcggtcgctgccctgcggggccgtccgactccggactcctgctgtggccgaggtgaggctgccgtcggccacactttgctacttctgccgctgtcgcctcggcttgggagcggcgttatttccacgaagcgctagggccttggcagcctcggcgctacctgcccagggctcccggtggccagtgctcagcagcccgggactccccgcagccttcgcttctttccctgcctgccctcagcgcagctacagcacggaggagaagccccagcagcaccagaaaaccaagatgatcgtcctgggattctccaaccccatcaactgggttaggactcgaattaaggccttccttatctgggcctatttcgacaaagagttcagcatcacagagttctccgagggagcgaagcaggcttttgctcatgtatccaagttgctgtcacagtgtaaatttgatctgttggaagaacttgtggccaaagaggtgctacatgcattgaaagaaaaggttacttcactacctgacaaccataaaaatgcccttgctgctaacatagatgaaattgtatttacatcaacaggagacatctccatttactatgatgagaaaggaaggaagtttgttaacatcctgatgtgcttttggtatctaaccagtgccaacatccccagtgaaactttaagaggagccagtgtattccaggttaagttggggaatcagaatgtggaaactaaacaacttcttagtgcaagctatgagtttcagagggagttcacacaaggagtaaagcctgactggaccattgcacggattgaacactcaaaattattagaataattttcttggaaaaatcagcttatggactttagcagttgctgtgaaaaactaaggaagaaaaattttggggtcatttgatcttcacttaatctaagtctgtgaattacttttatattattttgaaatactccttgcagtatattggcatgatacagtaaaagcattttccacagattgttatcaccttctttaaaagaagtcaaaatttaaaaaatacaatagcacgttgttggtgtcatattcaataacatttccaatgctacatataattttatagacataataaagaaggtattgaaaaaactaaaaaaaaaaaaccagaaaaaa

SEQ ID NO: 287541 - DNA, 1211 bp, Homo sapiens
  misc_feature (6)..(6): n is a, c, g, or t
agaggncccccgacgagttgtccgagttacacaaatctgcttcaaaataacaaaccccaaaaatgacctaagaaataaaatgtattctgttttactaaggtaaaagagaattatatcctcattttttttttgctcttcttaaaagaaatgtgtttttttttaaattttgctttatttgtaattacccaaaatattctatatatttaaatacttaatttaaatctactgaattgcctgttaagaaataatttttaaagagcactgtcgtcaatactaaactttatcttttctgatgtttcttactaagactatgggtacttcataaacattgttattttcaagattgatttaatgtatgtaaactaaattccactatttattcctaaattggtaacagtgctatttgaaaaatagctttttgcctgtatcctaggttatgtatttaaagtgctgtttgcatcaccagagtccagtttatctgtcctcatattaggcatgtgttatagctagtatttaacacatactagctatatgtgttatttatataacacatatatccaagtttctcttaggggctggtagatgttgaatatagattagtccattaaaaatacttacattacttgagaatgtacttcaattttgtgggtatatttattgtgattgaatgggtaggttaaacttttttttgttttgattttgatttaatattaaccattatcttgttgccaaaaattcttctaaatatacacttgcaaattacatagttatctaacacatacttggactgatgtaagatttacattatttgcaatgtctttcctaggtttcagagggagttcacacaaggagtaaagcctgactggaccattgcacggattgaacactcaaaattattagaataattttcttggaaaaatcagcttatggactttagcagttgctgtgaaaaactaaggaagaaaaattttggggtcatttgatcttcacttaatctaagtctgtgaattacttttatattattttgaaatactccttgcagtatattggcatgatacagtaaaagcattttccacagattgttatcaccttctttaaaagaagtcaaaatttaaaaaatacaatagcacgttgttggtgtcatattcaataacatttccaatgctacatataattttatagacataataaagaaggtattgaaaaaacta

SEQ ID NO: 287542 - DNA, 1356 bp, Homo sapiens
agttcccagctgtccgaaaggtcttcggaacttcggctctaaagcgttcctcagcgccatccgcccggaaacacgagcgacagagaaaaggtccgcgaggccggcagactccagagtggctgggtccgagcgcggggcgggttgccgaagggcctcggcctgggctgcgtgctggagagcggggacggggccgactcaccagaggctgcagcaacaggtccactttgctctccagtctctttctccgacaccgctgaggcggtttcccaccgacttcctttccatacagcaccggcaggcaccggggtgaagggtcataaaaatggcgctggccgctcgtttgctaccccagttcctgcactctcggtcgctgccctgcggggccgtccgactccggactcctgctgtggccgaggtgaggctgccgtcggccacactttgctacttctgccgctgtcgcctcggcttgggagcggcgttatttccacgaagcgctagggccttggcagcctcggcgctacctgcccagggctcccggtggccagtgctcagcagcccgggactccccgcagccttcgcttctttccctgcctgccctcagcgcagctacagcacggaggagaagccccagcagcaccagaaaaccaagatgatcgtcctgggattctccaaccccatcaactgggttaggactcgaattaaggccttccttatctgggcctatttcgacaaagagttcagcatcacagagttctccgagggagcgaagcaggcttttgctcatgtatccaagttgctgtcacagtgtaaatttgatctgttggaagaacttgtggccaaagaggtgctacatgcattgaaagaaaaggttacttcactacctgacaaccataaaaatgcccttgctgctaacatagatgaaattgtatttacatcaacaggagacatctccatttactatgatgagaaaggtttcagagggagttcacacaaggagtaaagcctgactggaccattgcacggattgaacactcaaaattattagaataattttcttggaaaaatcagcttatggactttagcagttgctgtgaaaaactaaggaagaaaaattttggggtcatttgatcttcacttaatctaagtctgtgaattacttttatattattttgaaatactccttgcagtatattggcatgatacagtaaaagcattttccacagattgttatcaccttctttaaaagaagtcaaaatttaaaaaatacaatagcacgttgttggtgtcatattcaataacatttccaatgctacatataattttatagacataataaagaaggtattgaaaaaacta

SEQ ID NO: 287543 - DNA, 448 bp, Homo sapiens
agacgggtgatttctgcatttccatctgagatggagtgaatatgatgattctgtgaaggtttattgcaacatgactttttcagcacagcaacaggaaaatttgactctgggtctgttctacaaaattaaagctttctcagcacaaaaaacagcatagactgtgagtgatggcggccatcttggttcatgtgtaaagactgaatttcagtgactaccaacggctatttcttagaatgtggcacttaccctgggttcaggctgtggtccttctactgcccatgaatgaattgctccatctgaacattcgggaacaggctcaaagccagctgcactacgaggagcacctccacaatcacaacagatcatcaaaaatgggaccactggtggtggagggatagtaatactagagttagcactgggtgcaaataaaaaacaaaacaacctgatt

SEQ ID NO: 287544 - DNA, 791 bp, Homo sapiens
tcctcatcgtctcttgccgctgccatgaaaggagtgctttttgcctcccaccatgattctgaggcctccccagccatgtagaattagccagcctgtttttgatgaagagcaactgtactggagagaaagcctgtattcatattcatcgtcatcaggcaaatcgaggagctgacttgcttaggatcatctgctggttgaatccatggatgcagaaccccagattcggagggctgaatgtactttcgataggttcctgagcagcagtgattatagtcacagcagactggacagtttggtgagcaagttcaggggctggcttagtgattcatagttctttcttcctcctcccccagcagttttgtttcagcagtgatttggtcaaatgtgaaccacaaaccagcagcaaaagcattttctaggaacttgttaaaactggaaggcccaaggttgcactcaggcttactgagtcagtcactccaagtggaccccatccctaaaccttgagactcactgctcctcttttgatctgggagagaaacagaaaaaagaaggaaaaaaaatccccaatgtgagtatgctggaaagtaaatttgaatagctttttatattgggtacttactgtgggtaatttacaaactattggaaggaaccacaaattcaaacacagccaaatttaaggtctctttagcagaaatcaatcttacatcatggcagttctcccattctccagtctttcacttgatagatcacttcctcattaggatgacctacagcaattctacatgaactgc

SEQ ID NO: 287545 - DNA, 684 bp, Homo sapiens
tgcgatgtaaatagttgttatactctattattttatttgtaatagttatcttttatttttttgtcttgaatattttcagtctgctggttgaatccatggatgcagaaccccagattcggagggctgaatgtactttcgataggttcctgagcagcagtgattatagtcacagcagactggacagtttggtgagcaagttcaggggctggcttagtgattcatagttctttcttcctcctcccccagcagttttgtttcagcagtgatttggtcaaatgtgaaccacaaaccagcagcaaaagcattttctaggaacttgttaaaactggaaggcccaaggttgcactcaggcttactgagtcagtcactccaagtggaccccatccctaaaccttgagactcactgctcctcttttgatctgggagagaaacagaaaaaagaaggaaaaaaaatccccaatgtgagtatgctggaaagtaaatttgaatagctttttatattgggtacttactgtgggtaatttacaaactattggaaggaaccacaaattcaaacacagccaaatttaaggtctctttagcagaaatcaatcttacatcatggcagttctcccattctccagtctttcacttgatagatcacttcctcattaggatgacctacagcaattctacatgaactgc

SEQ ID NO: 287546 - DNA, 1101 bp, Homo sapiens
tttctatgcctgacgtggagctaaatttgaaaagtcccaaagtcaaaggagacttagatattgcaggtcccaatttagaaggtgactttaaaggccccaaagtggatattaaggcaccagaagtcaatcttaatgcacctgatgtggatgttcatggtccagactggaatctgaaaatgcccaagatgaaaatgcccaaattcagtgtgtctggcttaaaagcagaagggccagatgtagctgtggatctaccaaaaggagacatcaacatagagggcccaagtatgaacattgagggcccagatctcaatgtggaaggtccggagggaggcttgaaaggtcccaaattcaagatgcctgacatgaatatcaaagctcccaagatctccatgcctgacattgacttaaacttgaaaggccccaaggtgaaaggtgatgtggatatttctcttcccaaacttgaaggggatctgaaagggccagaggttgatatcaaaggccctaaagtggacatcaatgccccagatgtggatgttcatggtccagactggcatctgaagatgcccaaagtgaaaatgcccaagttcagcatgcctggcttcaaaggagaaggccctgaagtcgatgttaccctccctaaagctgacattgacatttctggtcccaatgtagacgttgatgttccagacgtgaatattgaaggtccagatgcaaagctgaagggccccaagttcaagatgcctgagatgaacatcaaagcccccaagatctccatgcctgactttgacctgaacttgaagggacccaaaatgaagggtgatgtggttgtgtctttgcccaaagtggaaggtgatctaaaaggccctgaggtggacatcaagggccccaaagtggacattgacactcctgacattaacatcgaaggctcagagggtaaattcaagggacccaaatttaagataccagagatgcacctgaaggctcccaaaatatcgatgcctgacattgatttaaacctgaagggccccaaagtcaagggcgatgtggatgtttctctgcccaaaatggaaggtgacctcaagggtcctgaagttgacatca

SEQ ID NO: 287547 - DNA, 5819 bp, Homo sapiens
  misc_feature (485)..(485): n is a, c, g, or t
  misc_feature (494)..(494): n is a, c, g, or t
  misc_feature (497)..(497): n is a, c, g, or t
  misc_feature (499)..(499): n is a, c, g, or t
  misc_feature (877)..(877): n is a, c, g, or t
  misc_feature (1292)..(1292): n is a, c, g, or t
  misc_feature (3799)..(3799): n is a, c, g, or t
gagcggcgccctgctctggccgttgctcccgctcctgctcctgctgctgtcggcgcgggacggcgtgcgcgccgcgcagcctcaggccccgggttacttgattgcagctccctctgtttttcgcgcgggcgtggaggaagtcatcagcgtgaccatctttaactctccaagggaagtcacggtccaggctcagctggtggcccagggtgagccggtggtgcagagccagggagccatcctggataaagggacaatcaaactcaaggtgcccacgggcctccggggccaagcgcttctgaaagtgtggggccgcggctggcaggcggaggaggggcccctctttcacaaccagacctcggtgaccgtggacggccggggcgcttctgtattcatccagacggacaagcctgtgtacagaccccagcaccgagtgctcataagcatcttcaccgtctctccaaatctgaggcctgtcaacgagaagntggaagctncancnggacccccgaggctctcggatgatagagtggagacacttaaagccgttctgctgcggcatcaccaacatgagcttccccttgtccgaccagcctgtgttgggagaatggttcatttttgttgaaatgcaaggccacgcgtacaacaagtcttttgaagttcagaagtatgtgttgcccaagtttgagcttctgattgacccgccccggtatatccaagacctggacgcctgtgagacaggcactgtgcgggccaggtatacctttgggaaacctgtggctggtgccttaacgatcaacatgactgttaatggtgtagggtactacagccacgaggtgggacgccctgtcctcagaacaaccaagatcctcggctcccnggacttcgacatctgcgtgagggacatgatcccagcggacgtccctgagcacttccggggcagggtcagcatctgggccatggtgaccagtgtggacgggagccagcaggtcgcgttcgatgactccacccccgtgcagaggcagctggtggacatccggtactccaaggacacgaggaagcagttcaagccgggcctggcctacgtggggaaggtggagctatcctaccccgatggcagcccagctgagggggtgacggtccagattaaggcagagctgacaccaaaggataacatctacaccagtgaagttgtgtcccagcgtggactagtggggtttgaaatcccctccatccccacgtcagcccagcacgtgtggctggagaccaaggtgatggcactgaacgggaagccngtgggggctcagtacctgcccagctacctctccctcggcagctggtactcccccagccagtgctacctgcagctgcagccaccctcccacccactgcaggttggggaagaagcctatttttctgtgaagtccacatgtccctgcaactttaccctgtactacgaggtggctgcacggggcaatattgtgctatcgggccagcagcctgcccacaccacccagcagcgaagcaagcgggcggcccctgccctggagaaaccgattcgtttaacacacctttctgagacagagcccccaccagccccagaagctgaggtcgacgtgtgtgtgacctctcttcatctggccgtgacccccagcatggtcccccttggtcgcctgctggtcttctacgtcagggagaatggagaaggggtcgccgacagccttcagtttgcagtcgagaccttcttcgaaaaccaggtttcagtgacgtattcagcaaatgagacccaacctggggaggttgtcgacctgcggatcagggctgcaaggggcagctgtgtgtgcgtcgccgcagttgataagagtgtctacctgctcaggtctgggttccggctgactcctgcccaggttttccaggaactggaagattatgatgtttctgattcctttggcgtgtccagggaggatggtcctttttggtgggctgggctgacggcacaacgacgccggcgctcctctgtcttcccgtggccttggggcatcaccaaggactctgggtttgccttcaccgaaacgggactggtggtgatgaccgaccgagtgagcctgaaccaccggcaggacggtggcctctacaccgatgaggctgtccccgctttccagccccacacagggagcctggtggcagtggctccttccaggcacccccccagaacagagaagagaaaaaggactttcttccccgaaacatggatttggcattgtctcaacatcagtgacccatctggtgaggggacactcagtgtgaaggtcccggactccatcaccagctgggtgggtgaggccgtggccctgtccacctctcagggcttaggcatcgccgagccctccctgctgaagaccttcaagcccttcttcgtggacttcatgctccccgctctcatcatccgtggggagcaggtcaagatcccgctcagtgtctacaactacatgggcacctgcgctgaggtgtacatgaagctctcggttcccaagggcatccagtttgttgggcatcctggcaaacgccatgtgaccaagaagatgtgtgtggcccccggggaggctgagcccatctgggtcgttctgtccttcagcgacctgggactcaacaacatcacggccaaagcccttgcttacggagacacaaattgctgccgggatgggaggtccagcaaacaccctgaggagaatcacgccgacaggagggtccccatcggggtggatcacgtcaggcgcagtgtgatggttgaggcggaaggagtcccccgggcgtacacctacagcgcattcttctgtcccagtgagagagtccacatctccacccccaacaagtatgagttccagtatgtgcagcggccactgcgcctcacccgctttgatgtggctgtgcgagctcacaatgatgcccgtgtggccttgtcttctgggccccaggacacagcaggcatgatcgagatcgtcctgggggggcatcagaacaccaggtcatggatctccaccagcaagatgggagagcccgtggccagtgcacacacggccaagatcctctcctgggatgaattcagaacattctggatcagctggcgtggtggccttatccaggttggccatggtccagagccatccaatgagtctgtcattgtggcctggaccctcccgaggccaccagaggtccagttcattggcttttccaccggctggggctccatgggtgaattccgaatctggaggaagatggaggtggacgagagctacagcgaggccttcaccctgggggtcccacacggcgccatccctgggtctgagcgagccaccgcctccatcatcggggacgtcatggggccaaccctgaaccacctcaacaacctcctgcggctgccgtttggctgtggagagcagaacatgatccactttgcacccaacgtctttgtcttgaagtatcttcagaaaacccagcagctcagccctgaggtggagagagagaccaccgactacctagtacaaggctaccagcgccagctgacctacaagcgccaggatggctcctacagcgcgtttggggagcgggacgcatcggggagcatgtggctcacagcctttgtcctgaagtccttcgcacaggctcgcagctttatcttcgtggacccccgggagctggctgccgccaagagctggatcatccagcagcagcaggccgatggctccttcctggccgtgggcagggtcctgaacaaggacatccagggtgggatccacggcantgtcccgctgacagcctacgtggtggttgctctcctggaaacaggcacagcctcagaggaggagagaggctccactgacaaagcgaggcacttcctggagtctgctgcgcccctggccatggacccttatagctgtgccctgactacctacgcgctgaccctgctccgcagcccggcagcccctgaggcactgcgcaagctccgtagcctggccatcatgcgagatggggtcacccactggagcctgtcaaattcctgggacgtggacaagggcacattcttgagcttcagtgacagggtctctcagtcagtggtctcggccgaggtggaaatgacagcctacgcccttctgacctacactctgctgggtgacgtggctgccgccctgcctgtggtgaagtggctgtcccagcagcgaaatgcacttgggggcttctcctccactcaggacacctgcgtggctctgcaggccttggctgaatatgccatcttgtcctatgctggaggcatcaacctcactgtctccctggcctccaccaacctggactaccaggaaaccttcgagctgcacaggaccaaccagaaggttctgcagacagcagcgatccccagcctccccacggggctgtttgtgagtgccaagggggacggctgctgcctgatgcagattgatgtcacctacaatgtgcctgacccggtggccaagccagctttccagctgctcgtaagcctccaggagcctgaggcccagggacgcccgccccccatgcctgcctccgcagctgagggttcccgaggagactggcccccagctgacgatgatgacccagcggccgatcagcatcaccaggaatacaaggtgatgctggaggtgtgcaccaggtggctgcatgcagggtcttccaatatggctgtcctggaggtgcccctgctgtcaggcttccgggcagacatcgagagcctggagcagctgctccttgacaagcacatggggatgaagaggtatgaagtggctggacgccgagtgctcttctactttgatgagatccccagccggtgcctgacgtgcgtgcggttccgtgctctccgggagtgcgtggtgggcaggacgtcggcgctgccagtctccgtgtacgactactacgaacccgccttcgaggccactcgcttctacaacgtcagcacccacagcccactcgcccgggaactgtgcgccggacccgcgtgcaacgaagtggagcgcgcccctgcccggggcccgggctggttccccggcgagtcgggccctgccgtggcccctgaggagggggcggcgatcgcgcgatgcggctgcgaccacgactgcggcgcccaggggaacccggtgtgcggctccgacggggtggtctacgccagcgcctgccgcctgcgggaggccgcctgccgccaggccgcgcccctggagcccgcgcctcccagctgctgcgccctcgagcagcggctgccggcctcgtcgtcctccacctacggggatgacctggcttctgtggccccggggcctttacagcaggacgtgaagctgaatggagccggccttgaggtggaggactcagaccctgagcctgaaggggaggcggaggacagggtcacagccgggcctcggcctcctgtgagcagcgggaacctggaaagcagcacccagagcgccagcccgttccacagatggggccagactccggcccctcagagacatagtggccgggtggtgggggcccacaggccagggcttctgagccctgtcttcgtctacagcccagcctttcagagtggtggggaggagggtttatggatgtcaaacacctgcaccttgagataatcctacaaccacatgcagttgtgggaccgcagtttggtcctggggaccattcatacccacacacccagcttgtgcctgtggttaacatctcagaaaactctggtaaatgatcactccaggatattgacacgaatacacgttactgatcttactcacaaattctgg

SEQ ID NO: 287548 - DNA, 532 bp, Homo sapiens
tctgaggctgccctggccggtgggttccccacccctggcaccctacaagcgacaggccctgtggctccttcctcagcccgaggccccgtgcccacttgctgtagaggatgttgtaagataaaacctcatctccagggtcacagccgggcctcggcctcctgtgagcagcgggaacctggaaagcagcacccagagcgccagcccgttccacagatggggccagactccggcccctcagagacatagtggccgggtggtgggggcccacaggccagggcttctgagccctgtcttcgtctacagcccagcctttcagagtggtggggaggagggtttatggatgtcaaacacctgcaccttgagataatcctacaaccacatgcagttgtgggaccgcagtttggtcctggggaccattcatacccacacacccagcttgtgcctgtggttaacatctcagaaaactctggtaaatgatcactccaggatattgacacgaatacacgttactgatcttactcacaaattctgg

SEQ ID NO: 287549 - DNA, 1146 bp, Homo sapiens
cggcaggggacggggctgttgttgcagggcggcccagacaggacgccctgtctcctttctctcctacaaccgctttttaaaagtctgtttctgtttttgctggttccccggcgagtcgggccctgccgtggcccctgaggagggggcggcgatcgcgcgatgcggctgcgaccacgactgcggcgcccaggggaacccggtgtgcggctccgacggggtggtctacgccagcgcctgccgcctgcgggaggccgcctgccgccaggccgcgcccctggagcccgcgcctcccagctgctgcgccctcgcaggacgtgaagctgaatggagccggccttgaggtggaggactcagaccctgagcctgaaggggaggcggaggacagtcagagcggcttctcttcctaacggctgccctgctgagagcaggacgacaccatctggctgcatcctgtccctatcagcctgtgactctgtatggtgggtgggcagacctcagcccaggtgacacctgcctctaaatgaacccaaggaacagaatgacagagatctgcccgtccctaggatgagactcttgggacccaggtgtgggctcagcagtcaccggtgtggtgcaggggggacagctggaggtcccttgggagatcccccaccttcctagctacagctggagctccaagcaccccaaccccccagccttggagctgggcatcattttcctggggccacggcagctcccacagcctgacattctgttcccgggagaagaaacattcccagaaagcactcgtgtggccaaaagcctctttctgagcaaacacgatgtggactaaattagcaaaacatccagccggtgggcaacttcaaaacggaacaggctgcgtttctctgaaacacaaagccccggcctccctttggggcacccaggaccccaaattgccctaagactgtcccagctctcgcaccctctgccttcgccccccggggacctcgggctcacatcacaaggccctgcggggaagcagatggctctcagcaaatgcactttcagcttccggctgccggggctgggtgaccccggtgcttcctcaccgtgagttcctgatgtcctcgtgcccagaggaccagcccactcccagggccccca

SEQ ID NO: 287550 - DNA, 1010 bp, Homo sapiens
cggcaggggacggggctgttgttgcagggcggcccagacaggacgccctgtctcctttctctcctacaaccgctttttaaaagtctgtttctgtttttagcagcggctgccggcctcgtcgtcctccacctacggggatgacctggcttctgtggccccggggcctttacagcaggacgtgaagctgaatggagccggccttgaggtggaggactcagaccctgagcctgaaggggaggcggaggacagtcagagcggcttctcttcctaacggctgccctgctgagagcaggacgacaccatctggctgcatcctgtccctatcagcctgtgactctgtatggtgggtgggcagacctcagcccaggtgacacctgcctctaaatgaacccaaggaacagaatgacagagatctgcccgtccctaggatgagactcttgggacccaggtgtgggctcagcagtcaccggtgtggtgcaggggggacagctggaggtcccttgggagatcccccaccttcctagctacagctggagctccaagcaccccaaccccccagccttggagctgggcatcattttcctggggccacggcagctcccacagcctgacattctgttcccgggagaagaaacattcccagaaagcactcgtgtggccaaaagcctctttctgagcaaacacgatgtggactaaattagcaaaacatccagccggtgggcaacttcaaaacggaacaggctgcgtttctctgaaacacaaagccccggcctccctttggggcacccaggaccccaaattgccctaagactgtcccagctctcgcaccctctgccttcgccccccggggacctcgggctcacatcacaaggccctgcggggaagcagatggctctcagcaaatgcactttcagcttccggctgccggggctgggtgaccccggtgcttcctcaccgtgagttcctgatgtcctcgtgcccagaggaccagcccactcccagggccccca

SEQ ID NO: 287551 - DNA, 440 bp, Homo sapiens
gaaatagatgcagcccacaaaatccccagggctgctcagcagagtggtgtggatgggtacagtgtcaacctcggtggtggccaggtgctgtggtcctcagacaccttgcaccggtgtcagggctcctgaggccaccttagggacagaagccagcccctcctctctgcttgctttcttcagtgttgcccaagtttgagcttctgattgacccgccccggtatatccaagacctggacgcctgtgagacaggcactgtgcgggccaggtatacctttgggaaacctgtggctggtgccttaacgatcaacatgactgttaatggtgtagggtactacagccacgaggtgggacgccctgtcctcagaacaaccaaggtgagaaacagggaccccttctaccccctgacccaacccccaggttcacctccaccagcacacatt

SEQ ID NO: 287552 - DNA, 5284 bp, Homo sapiens
  misc_feature (416)..(416): n is a, c, g, or t
  misc_feature (831)..(831): n is a, c, g, or t
  misc_feature (3338)..(3338): n is a, c, g, or t
gcttaagagagaagagaaaaaggactttcttccccgaaacatggatttggcattgtctcaacatcaggtacattaagatttcttttctgctgcggcatcaccaacatgagcttccccttgtccgaccagcctgtgttgggagaatggttcatttttgttgaaatgcaaggccacgcgtacaacaagtcttttgaagttcagaagtatgtgttgcccaagtttgagcttctgattgacccgccccggtatatccaagacctggacgcctgtgagacaggcactgtgcgggccaggtatacctttgggaaacctgtggctggtgccttaacgatcaacatgactgttaatggtgtagggtactacagccacgaggtgggacgccctgtcctcagaacaaccaagatcctcggctcccnggacttcgacatctgcgtgagggacatgatcccagcggacgtccctgagcacttccggggcagggtcagcatctgggccatggtgaccagtgtggacgggagccagcaggtcgcgttcgatgactccacccccgtgcagaggcagctggtggacatccggtactccaaggacacgaggaagcagttcaagccgggcctggcctacgtggggaaggtggagctatcctaccccgatggcagcccagctgagggggtgacggtccagattaaggcagagctgacaccaaaggataacatctacaccagtgaagttgtgtcccagcgtggactagtggggtttgaaatcccctccatccccacgtcagcccagcacgtgtggctggagaccaaggtgatggcactgaacgggaagccngtgggggctcagtacctgcccagctacctctccctcggcagctggtactcccccagccagtgctacctgcagctgcagccaccctcccacccactgcaggttggggaagaagcctatttttctgtgaagtccacatgtccctgcaactttaccctgtactacgaggtggctgcacggggcaatattgtgctatcgggccagcagcctgcccacaccacccagcagcgaagcaagcgggcggcccctgccctggagaaaccgattcgtttaacacacctttctgagacagagcccccaccagccccagaagctgaggtcgacgtgtgtgtgacctctcttcatctggccgtgacccccagcatggtcccccttggtcgcctgctggtcttctacgtcagggagaatggagaaggggtcgccgacagccttcagtttgcagtcgagaccttcttcgaaaaccaggtttcagtgacgtattcagcaaatgagacccaacctggggaggttgtcgacctgcggatcagggctgcaaggggcagctgtgtgtgcgtcgccgcagttgataagagtgtctacctgctcaggtctgggttccggctgactcctgcccaggttttccaggaactggaagattatgatgtttctgattcctttggcgtgtccagggaggatggtcctttttggtgggctgggctgacggcacaacgacgccggcgctcctctgtcttcccgtggccttggggcatcaccaaggactctgggtttgccttcaccgaaacgggactggtggtgatgaccgaccgagtgagcctgaaccaccggcaggacggtggcctctacaccgatgaggctgtccccgctttccagccccacacagggagcctggtggcagtggctccttccaggcacccccccagaacagagaagagaaaaaggactttcttccccgaaacatggatttggcattgtctcaacatcagtgacccatctggtgaggggacactcagtgtgaaggtcccggactccatcaccagctgggtgggtgaggccgtggccctgtccacctctcagggcttaggcatcgccgagccctccctgctgaagaccttcaagcccttcttcgtggacttcatgctccccgctctcatcatccgtggggagcaggtcaagatcccgctcagtgtctacaactacatgggcacctgcgctgaggtgtacatgaagctctcggttcccaagggcatccagtttgttgggcatcctggcaaacgccatgtgaccaagaagatgtgtgtggcccccggggaggctgagcccatctgggtcgttctgtccttcagcgacctgggactcaacaacatcacggccaaagcccttgcttacggagacacaaattgctgccgggatgggaggtccagcaaacaccctgaggagaatcacgccgacaggagggtccccatcggggtggatcacgtcaggcgcagtgtgatggttgaggcggaaggagtcccccgggcgtacacctacagcgcattcttctgtcccagtgagagagtccacatctccacccccaacaagtatgagttccagtatgtgcagcggccactgcgcctcacccgctttgatgtggctgtgcgagctcacaatgatgcccgtgtggccttgtcttctgggccccaggacacagcaggcatgatcgagatcgtcctgggggggcatcagaacaccaggtcatggatctccaccagcaagatgggagagcccgtggccagtgcacacacggccaagatcctctcctgggatgaattcagaacattctggatcagctggcgtggtggccttatccaggttggccatggtccagagccatccaatgagtctgtcattgtggcctggaccctcccgaggccaccagaggtccagttcattggcttttccaccggctggggctccatgggtgaattccgaatctggaggaagatggaggtggacgagagctacagcgaggccttcaccctgggggtcccacacggcgccatccctgggtctgagcgagccaccgcctccatcatcggggacgtcatggggccaaccctgaaccacctcaacaacctcctgcggctgccgtttggctgtggagagcagaacatgatccactttgcacccaacgtctttgtcttgaagtatcttcagaaaacccagcagctcagccctgaggtggagagagagaccaccgactacctagtacaaggctaccagcgccagctgacctacaagcgccaggatggctcctacagcgcgtttggggagcgggacgcatcggggagcatgtggctcacagcctttgtcctgaagtccttcgcacaggctcgcagctttatcttcgtggacccccgggagctggctgccgccaagagctggatcatccagcagcagcaggccgatggctccttcctggccgtgggcagggtcctgaacaaggacatccagggtgggatccacggcantgtcccgctgacagcctacgtggtggttgctctcctggaaacaggcacagcctcagaggaggagagaggctccactgacaaagcgaggcacttcctggagtctgctgcgcccctggccatggacccttatagctgtgccctgactacctacgcgctgaccctgctccgcagcccggcagcccctgaggcactgcgcaagctccgtagcctggccatcatgcgagatggggtcacccactggagcctgtcaaattcctgggacgtggacaagggcacattcttgagcttcagtgacagggtctctcagtcagtggtctcggccgaggtggaaatgacagcctacgcccttctgacctacactctgctgggtgacgtggctgccgccctgcctgtggtgaagtggctgtcccagcagcgaaatgcacttgggggcttctcctccactcaggacacctgcgtggctctgcaggccttggctgaatatgccatcttgtcctatgctggaggcatcaacctcactgtctccctggcctccaccaacctggactaccaggaaaccttcgagctgcacaggaccaaccagaaggttctgcagacagcagcgatccccagcctccccacggggctgtttgtgagtgccaagggggacggctgctgcctgatgcagattgatgtcacctacaatgtgcctgacccggtggccaagccagctttccagctgctcgtaagcctccaggagcctgaggcccagggacgcccgccccccatgcctgcctccgcagctgagggttcccgaggagactggcccccagctgacgatgatgacccagcggccgatcagcatcaccaggaatacaaggtgatgctggaggtgtgcaccaggtggctgcatgcagggtcttccaatatggctgtcctggaggtgcccctgctgtcaggcttccgggcagacatcgagagcctggagcagctgctccttgacaagcacatggggatgaagaggtatgaagtggctggacgccgagtgctcttctactttgatgagatccccagccggtgcctgacgtgcgtgcggttccgtgctctccgggagtgcgtggtgggcaggacgtcggcgctgccagtctccgtgtacgactactacgaacccgccttcgaggccactcgcttctacaacgtcagcacccacagcccactcgcccgggaactgtgcgccggacccgcgtgcaacgaagtggagcgcgcccctgcccggggcccgggctggttccccggcgagtcgggccctgccgtggcccctgaggagggggcggcgatcgcgcgatgcggctgcgaccacgactgcggcgcccaggggaacccggtgtgcggctccgacggggtggtctacgccagcgcctgccgcctgcgggaggccgcctgccgccaggccgcgcccctggagcccgcgcctcccagctgctgcgccctcgcaggacgtgaagctgaatggagccggccttgaggtggaggactcagaccctgagcctgaaggggaggcggaggacagggtcacagccgggcctcggcctcctgtgagcagcgggaacctggaaagcagcacccagagcgccagcccgttccacagatggggccagactccggcccctcagagacatagtggccgggtggtgggggcccacaggccagggcttctgagccctgtcttcgtctacagcccagcctttcagagtggtggggaggagggtttatggatgtcaaacacctgcaccttgagataatcctacaaccacatgcagttgtgggaccgcagtttggtcctggggaccattcatacccacacacccagcttgtgcctgtggttaacatctcagaaaactctggtaaatgatcactccaggatattgacacgaatacacgttactgatcttactcacaaattctgg

SEQ ID NO: 287553 - DNA, 3771 bp, Homo sapiens
  misc_feature (1825)..(1825): n is a, c, g, or t
cagtggccacagggtgattcattcccttatgcttctgggggctgtcagcatccacttccccaccaatggtttgggtgttgtctgttgcctaggaaacgggactggtggtgatgaccgaccgagtgagcctgaaccaccggcaggacggtggcctctacaccgatgaggctgtccccgctttccagccccacacagggagcctggtggcagtggctccttccaggcacccccccagaacagagaagagaaaaaggactttcttccccgaaacatggatttggcattgtctcaacatcagtgacccatctggtgaggggacactcagtgtgaaggtcccggactccatcaccagctgggtgggtgaggccgtggccctgtccacctctcagggcttaggcatcgccgagccctccctgctgaagaccttcaagcccttcttcgtggacttcatgctccccgctctcatcatccgtggggagcaggtcaagatcccgctcagtgtctacaactacatgggcacctgcgctgaggtgtacatgaagctctcggttcccaagggcatccagtttgttgggcatcctggcaaacgccatgtgaccaagaagatgtgtgtggcccccggggaggctgagcccatctgggtcgttctgtccttcagcgacctgggactcaacaacatcacggccaaagcccttgcttacggagacacaaattgctgccgggatgggaggtccagcaaacaccctgaggagaatcacgccgacaggagggtccccatcggggtggatcacgtcaggcgcagtgtgatggttgaggcggaaggagtcccccgggcgtacacctacagcgcattcttctgtcccagtgagagagtccacatctccacccccaacaagtatgagttccagtatgtgcagcggccactgcgcctcacccgctttgatgtggctgtgcgagctcacaatgatgcccgtgtggccttgtcttctgggccccaggacacagcaggcatgatcgagatcgtcctgggggggcatcagaacaccaggtcatggatctccaccagcaagatgggagagcccgtggccagtgcacacacggccaagatcctctcctgggatgaattcagaacattctggatcagctggcgtggtggccttatccaggttggccatggtccagagccatccaatgagtctgtcattgtggcctggaccctcccgaggccaccagaggtccagttcattggcttttccaccggctggggctccatgggtgaattccgaatctggaggaagatggaggtggacgagagctacagcgaggccttcaccctgggggtcccacacggcgccatccctgggtctgagcgagccaccgcctccatcatcggggacgtcatggggccaaccctgaaccacctcaacaacctcctgcggctgccgtttggctgtggagagcagaacatgatccactttgcacccaacgtctttgtcttgaagtatcttcagaaaacccagcagctcagccctgaggtggagagagagaccaccgactacctagtacaaggctaccagcgccagctgacctacaagcgccaggatggctcctacagcgcgtttggggagcgggacgcatcggggagcatgtggctcacagcctttgtcctgaagtccttcgcacaggctcgcagctttatcttcgtggacccccgggagctggctgccgccaagagctggatcatccagcagcagcaggccgatggctccttcctggccgtgggcagggtcctgaacaaggacatccagggtgggatccacggcantgtcccgctgacagcctacgtggtggttgctctcctggaaacaggcacagcctcagaggaggagagaggctccactgacaaagcgaggcacttcctggagtctgctgcgcccctggccatggacccttatagctgtgccctgactacctacgcgctgaccctgctccgcagcccggcagcccctgaggcactgcgcaagctccgtagcctggccatcatgcgagatggggtcacccactggagcctgtcaaattcctgggacgtggacaagggcacattcttgagcttcagtgacagggtctctcagtcagtggtctcggccgaggtggaaatgacagcctacgcccttctgacctacactctgctgggtgacgtggctgccgccctgcctgtggtgaagtggctgtcccagcagcgaaatgcacttgggggcttctcctccactcaggacacctgcgtggctctgcaggccttggctgaatatgccatcttgtcctatgctggaggcatcaacctcactgtctccctggcctccaccaacctggactaccaggaaaccttcgagctgcacaggaccaaccagaaggttctgcagacagcagcgatccccagcctccccacggggctgtttgtgagtgccaagggggacggctgctgcctgatgcagattgatgtcacctacaatgtgcctgacccggtggccaagccagctttccagctgctcgtaagcctccaggagcctgaggcccagggacgcccgccccccatgcctgcctccgcagctgagggttcccgaggagactggcccccagctgacgatgatgacccagcggccgatcagcatcaccaggaatacaaggtgatgctggaggtgtgcaccaggtggctgcatgcagggtcttccaatatggctgtcctggaggtgcccctgctgtcaggcttccgggcagacatcgagagcctggagcagctgctccttgacaagcacatggggatgaagaggtatgaagtggctggacgccgagtgctcttctactttgatgagatccccagccggtgcctgacgtgcgtgcggttccgtgctctccgggagtgcgtggtgggcaggacgtcggcgctgccagtctccgtgtacgactactacgaacccgccttcgaggccactcgcttctacaacgtcagcacccacagcccactcgcccgggaactgtgcgccggacccgcgtgcaacgaagtggagcgcgcccctgcccggggcccgggctggttccccggcgagtcgggccctgccgtggcccctgaggagggggcggcgatcgcgcgatgcggctgcgaccacgactgcggcgcccaggggaacccggtgtgcggctccgacggggtggtctacgccagcgcctgccgcctgcgggaggccgcctgccgccaggccgcgcccctggagcccgcgcctcccagctgctgcgccctcgcaggacgtgaagctgaatggagccggccttgaggtggaggactcagaccctgagcctgaaggggaggcggaggacagggtcacagccgggcctcggcctcctgtgagcagcgggaacctggaaagcagcacccagagcgccagcccgttccacagatggggccagactccggcccctcagagacatagtggccgggtggtgggggcccacaggccagggcttctgagccctgtcttcgtctacagcccagcctttcagagtggtggggaggagggtttatggatgtcaaacacctgcaccttgagataatcctacaaccacatgcagttgtgggaccgcagtttggtcctggggaccattcatacccacacacccagcttgtgcctgtggttaacatctcagaaaactctggtaaatgatcactccaggatattgacacgaatacacgttactgatcttactcacaaattctgg

SEQ ID NO: 287554 - DNA, 5722 bp, Homo sapiens
  misc_feature (416)..(416): n is a, c, g, or t
  misc_feature (831)..(831): n is a, c, g, or t
  misc_feature (3338)..(3338): n is a, c, g, or t
gcttaagagagaagagaaaaaggactttcttccccgaaacatggatttggcattgtctcaacatcaggtacattaagatttcttttctgctgcggcatcaccaacatgagcttccccttgtccgaccagcctgtgttgggagaatggttcatttttgttgaaatgcaaggccacgcgtacaacaagtcttttgaagttcagaagtatgtgttgcccaagtttgagcttctgattgacccgccccggtatatccaagacctggacgcctgtgagacaggcactgtgcgggccaggtatacctttgggaaacctgtggctggtgccttaacgatcaacatgactgttaatggtgtagggtactacagccacgaggtgggacgccctgtcctcagaacaaccaagatcctcggctcccnggacttcgacatctgcgtgagggacatgatcccagcggacgtccctgagcacttccggggcagggtcagcatctgggccatggtgaccagtgtggacgggagccagcaggtcgcgttcgatgactccacccccgtgcagaggcagctggtggacatccggtactccaaggacacgaggaagcagttcaagccgggcctggcctacgtggggaaggtggagctatcctaccccgatggcagcccagctgagggggtgacggtccagattaaggcagagctgacaccaaaggataacatctacaccagtgaagttgtgtcccagcgtggactagtggggtttgaaatcccctccatccccacgtcagcccagcacgtgtggctggagaccaaggtgatggcactgaacgggaagccngtgggggctcagtacctgcccagctacctctccctcggcagctggtactcccccagccagtgctacctgcagctgcagccaccctcccacccactgcaggttggggaagaagcctatttttctgtgaagtccacatgtccctgcaactttaccctgtactacgaggtggctgcacggggcaatattgtgctatcgggccagcagcctgcccacaccacccagcagcgaagcaagcgggcggcccctgccctggagaaaccgattcgtttaacacacctttctgagacagagcccccaccagccccagaagctgaggtcgacgtgtgtgtgacctctcttcatctggccgtgacccccagcatggtcccccttggtcgcctgctggtcttctacgtcagggagaatggagaaggggtcgccgacagccttcagtttgcagtcgagaccttcttcgaaaaccaggtttcagtgacgtattcagcaaatgagacccaacctggggaggttgtcgacctgcggatcagggctgcaaggggcagctgtgtgtgcgtcgccgcagttgataagagtgtctacctgctcaggtctgggttccggctgactcctgcccaggttttccaggaactggaagattatgatgtttctgattcctttggcgtgtccagggaggatggtcctttttggtgggctgggctgacggcacaacgacgccggcgctcctctgtcttcccgtggccttggggcatcaccaaggactctgggtttgccttcaccgaaacgggactggtggtgatgaccgaccgagtgagcctgaaccaccggcaggacggtggcctctacaccgatgaggctgtccccgctttccagccccacacagggagcctggtggcagtggctccttccaggcacccccccagaacagagaagagaaaaaggactttcttccccgaaacatggatttggcattgtctcaacatcagtgacccatctggtgaggggacactcagtgtgaaggtcccggactccatcaccagctgggtgggtgaggccgtggccctgtccacctctcagggcttaggcatcgccgagccctccctgctgaagaccttcaagcccttcttcgtggacttcatgctccccgctctcatcatccgtggggagcaggtcaagatcccgctcagtgtctacaactacatgggcacctgcgctgaggtgtacatgaagctctcggttcccaagggcatccagtttgttgggcatcctggcaaacgccatgtgaccaagaagatgtgtgtggcccccggggaggctgagcccatctgggtcgttctgtccttcagcgacctgggactcaacaacatcacggccaaagcccttgcttacggagacacaaattgctgccgggatgggaggtccagcaaacaccctgaggagaatcacgccgacaggagggtccccatcggggtggatcacgtcaggcgcagtgtgatggttgaggcggaaggagtcccccgggcgtacacctacagcgcattcttctgtcccagtgagagagtccacatctccacccccaacaagtatgagttccagtatgtgcagcggccactgcgcctcacccgctttgatgtggctgtgcgagctcacaatgatgcccgtgtggccttgtcttctgggccccaggacacagcaggcatgatcgagatcgtcctgggggggcatcagaacaccaggtcatggatctccaccagcaagatgggagagcccgtggccagtgcacacacggccaagatcctctcctgggatgaattcagaacattctggatcagctggcgtggtggccttatccaggttggccatggtccagagccatccaatgagtctgtcattgtggcctggaccctcccgaggccaccagaggtccagttcattggcttttccaccggctggggctccatgggtgaattccgaatctggaggaagatggaggtggacgagagctacagcgaggccttcaccctgggggtcccacacggcgccatccctgggtctgagcgagccaccgcctccatcatcggggacgtcatggggccaaccctgaaccacctcaacaacctcctgcggctgccgtttggctgtggagagcagaacatgatccactttgcacccaacgtctttgtcttgaagtatcttcagaaaacccagcagctcagccctgaggtggagagagagaccaccgactacctagtacaaggctaccagcgccagctgacctacaagcgccaggatggctcctacagcgcgtttggggagcgggacgcatcggggagcatgtggctcacagcctttgtcctgaagtccttcgcacaggctcgcagctttatcttcgtggacccccgggagctggctgccgccaagagctggatcatccagcagcagcaggccgatggctccttcctggccgtgggcagggtcctgaacaaggacatccagggtgggatccacggcantgtcccgctgacagcctacgtggtggttgctctcctggaaacaggcacagcctcagaggaggagagaggctccactgacaaagcgaggcacttcctggagtctgctgcgcccctggccatggacccttatagctgtgccctgactacctacgcgctgaccctgctccgcagcccggcagcccctgaggcactgcgcaagctccgtagcctggccatcatgcgagatggggtcacccactggagcctgtcaaattcctgggacgtggacaagggcacattcttgagcttcagtgacagggtctctcagtcagtggtctcggccgaggtggaaatgacagcctacgcccttctgacctacactctgctgggtgacgtggctgccgccctgcctgtggtgaagtggctgtcccagcagcgaaatgcacttgggggcttctcctccactcaggacacctgcgtggctctgcaggccttggctgaatatgccatcttgtcctatgctggaggcatcaacctcactgtctccctggcctccaccaacctggactaccaggaaaccttcgagctgcacaggaccaaccagaaggttctgcagacagcagcgatccccagcctccccacggggctgtttgtgagtgccaagggggacggctgctgcctgatgcagattgatgtcacctacaatgtgcctgacccggtggccaagccagctttccagctgctcgtaagcctccaggagcctgaggcccagggacgcccgccccccatgcctgcctccgcagctgagggttcccgaggagactggcccccagctgacgatgatgacccagcggccgatcagcatcaccaggaatacaaggtgatgctggaggtgtgcaccaggtggctgcatgcagggtcttccaatatggctgtcctggaggtgcccctgctgtcaggcttccgggcagacatcgagagcctggagcagctgctccttgacaagcacatggggatgaagaggtatgaagtggctggacgccgagtgctcttctactttgatgagatccccagccggtgcctgacgtgcgtgcggttccgtgctctccgggagtgcgtggtgggcaggacgtcggcgctgccagtctccgtgtacgactactacgaacccgccttcgaggccactcgcttctacaacgtcagcacccacagcccactcgcccgggaactgtgcgccggacccgcgtgcaacgaagtggagcgcgcccctgcccggggcccgggctggttccccggcgagtcgggccctgccgtggcccctgaggagggggcggcgatcgcgcgatgcggctgcgaccacgactgcggcgcccaggggaacccggtgtgcggctccgacggggtggtctacgccagcgcctgccgcctgcgggaggccgcctgccgccaggccgcgcccctggagcccgcgcctcccagctgctgcgccctcgagcagcggctgccggcctcgtcgtcctccacctacggggatgacctggcttctgtggccccggggcctttacagcaggacgtgaagctgaatggagccggccttgaggtggaggactcagaccctgagcctgaaggggaggcggaggacagtcagagcggcttctcttcctaacggctgccctgctgagagcaggacgacaccatctggctgcatcctgtccctatcagcctgtgactctgtatggtgggtgggcagacctcagcccaggtgacacctgcctctaaatgaacccaaggaacagaatgacagagatctgcccgtccctaggatgagactcttgggacccaggtgtgggctcagcagtcaccggtgtggtgcaggggggacagctggaggtcccttgggagatcccccaccttcctagctacagctggagctccaagcaccccaaccccccagccttggagctgggcatcattttcctggggccacggcagctcccacagcctgacattctgttcccgggagaagaaacattcccagaaagcactcgtgtggccaaaagcctctttctgagcaaacacgatgtggactaaattagcaaaacatccagccggtgggcaacttcaaaacggaacaggctgcgtttctctgaaacacaaagccccggcctccctttggggcacccaggaccccaaattgccctaagactgtcccagctctcgcaccctctgccttcgccccccggggacctcgggctcacatcacaaggccctgcggggaagcagatggctctcagcaaatgcactttcagcttccggctgccggggctgggtgaccccggtgcttcctcaccgtgagttcctgatgtcctcgtgcccagaggaccagcccactcccagggccccca

SEQ ID NO: 287555 - DNA, 13816 bp, Homo sapiens
  misc_feature (13775)..(13775): n is a, c, g, or t
agcagaggagtgagtcctggccgcgtccccgtcgctagggaaaccgatgcagctggaggccgcgcgcgatgcggctcgcggaggagcgggccgcgctcgcggcggagaacgcggatggggaacccggcgccgaccgacgactgcgactcctggggacctacgtggccatgagcctgcggccggctgcgggcgcctgggagcgttgcgcggggagtgctgaggcggagcagctgctccaggccttcctgggccgcgatgctgccgaggggccgcggccgctgctggtggtgcggcccgggcccaggggcctggcaatacgccccgggctggaggtgggacctgagtcgggcctggctggcgctaaggcgctttttttccttcgcaccgggcccgagcctccagggcccgacagcttccgcggcgcagtggtctgcggggacctgcccgcggcacctctggagcacctagccgcgctgttctcggaggttgttctacccgtcctggccaatgagaagaatcgcctaaactggccccacatgatatgtgaggatgtcaggcggcacgcccacagcctccaatgtgacctctcagttatacttgagcaagtgaagggaaaaactttgctgcctcttccagcaggctcagaaaaaatggagtttgcggattccaaaagtgagacagtcttggattctatagataagtcagtcatctatgccattgagtctgcagtgatcaaatggagctaccaagtccaggtggtactcaagagagagtcttcccagccactcttacaaggggagaatcccacccctaaggtggagttggagttctggaagagcaggtatgaagatctgaaatacatctataatcaactgagaacaataacggtgaggggcatggccaagctcctggacaagcttcagagtagctactttccagctttcaaagccatgtacagagatgttgttgcagctctagcagaggcacaggacatccatgtgcacctgataccgctccagcgccacctggaagctctggagaatgcagaatttccggaggtgaagccccagctgcggcccctgctccacgtggtctgtctgatttgggccacatgcaagtcctaccgctccccgggaaggctgactgtgctgctccaggagatttgcaaccttctcatccagcaggcctctaattatctcagcccagaagacctgctgagaagtgaggtagaagaaagtcagagaaaactgcaagtggtctcagacactttgagcttcttcaagcaagagtttcaggacagaagggagaatctccacacttacttcaaagagaaccaggaagtcaaggaatgggatttccagtcttctttggtctttgtgcgattggatggcttcctgggacgactgcacgtggtggagggtcttctgaagacggccctggatttccacaaactgggaaaggtggagttcagcggcgtcagagggaatgctctgagtcagcaggtccagcaaatgcatgaagaatttcaagagatgtacaggcttctctcaggatcctcctccgactgcctgtacctccaaagcacggactttgaaaatgacgtctctgaatttaaccagaaagtagaagatcttgaccgaagattggggactatctttattcaagcttttgatgatgcacctggcttggagcatgcctttaagctgctagacatagcaggaaacctccttgaaagaccgctggtagcgagggatacatctgataaatacctggtcctcatccaaatgttcaacaaagatctggatgcagtgaggatgatctacagtcagcacgtccaggaggaagcagaacttgggttctccccggtgcacaagaacatgcccaccgtggctggcggcctccgctgggcacaggagctgaggcagcgcatccagggtcctttcagcaactttggacgcatcacacacccttgcatggaatctgcagaaggaaagcgaatgcaacaaaaatatgaagatatgctgtcattgctagaaaagtatgagacaagactttatgaggattggtgccggacagtatcagagaagtcacagtacaatctttcccaaccacttctaaaacgtgacccagagacgaaggagatcactatcaactttaacccacagctgatttcagtgctgaaagaaatgagctatcttgaacccagagagatgaaacacatgcctgagacagcagcagccatgttctcctccagggatttctatcggcagcttgtggctaatttagagttgatggcaaattggtacaacaaggttatgaaaactctgctggaggtggaatttccattagtggaggaagagctgcaaaatattgatctccgcctcagagcagcagaggagactttgaactggaaaacagaaggcatttgcgattatgtcactgaaatcaccagtagtattcatgatcttgaacaaagaattcagaaaactaaagacaatgtggaagagatccaaaacatcatgaaaacatgggtgactccaatatttaagacaaaagatggaaaaagggaatcccttctttctctggatgatcggcatgatcgaatggaaaaatattacaatctcatcaaggaatctggccttaagatccacgcccttgttcaggaaaacctgggtctattttcagcagacccaacctccaatatctggaagacttatgttaactctattgacaatttgttgctgaatggattctttcttgccattgagtgctccctcaagtatcttctggaaaatactgagtgtaaggcaggacttaccccaatatttgaagcacaactgagtctagccatcccagagctagttttctatccgtctctggagtctggagtgaaggggggtttctgtgacattgttgagggtctcatcaccagcatttttaggataccatctctggtgccacggctttccccacaaaatggctctcctcactatcaggtcgacctggacggtataccagatttggcaaacatgcggcgcacactcatggagagagtccagagaatgatgggcctctgctgtggctatcagagcaccttcagccagtattcgtacctctatgtggaggaccggaaggaggttctgggtcagtttctgctgtacgggcacatcctcactccggaagaaattgaagaccatgtggaagatggcatcccagagaaccctcccctcctttctcagtttaaagtgcaaatcgactcctatgaaacgctctatgaagaggtgtgcaggctggaacccatcaaggtgtttgacggctggatgaaaattgatattcgaccctttaaggcatctctgctgaatattattaagaggtggagcctcctgttcaaacagcatcttgtggaccacgtcactcacagcttggccaacctggacgcgtttataaagaagagtgagagcggcttactcaagaaagttgaaaaaggagatttccaaggcttggttgagatcatgggacaccttatggctgttaaagaacggcagagtaacactgatgagatgtttgagcccttaaagcagactattgaattgctgaagacctatgaacaagaattgccagaaacagtgtttaagcagctggaggagctgcctgagaaatggaacaacataaaaaaggtggccattactgtgaagcagcaggtggccccactgcaggcaaatgaagtgacactcctccgccagaggtgcacagccttcgatgcagaacagcagcaattctgggagcaattccacaaagaagccccgttcaggtttgatagcatccaccctcatcaaatgctggatgccaggcacatcgagatccagcagatggaatccactatggcctccatttctgagtctgccagcttatttgaagtcaatgtccctgactataagcagctgaggcagtgcaggaaggaggtctgccagctgaaggagctctgggacaccattggaatggtgacctccagcatccatgcctgggagaccacaccctggaggaatatcaacgtggaagccatggagttggagtgcaaacagtttgcccggcatatccgaaacctggacaaggaggtcagggcctgggatgcattcacaggcctggaaagcactgtgtggaacacgctgagctccctgagggcagtagctgagctgcagaatccagccatccgggagcggcactggaggcagctgatgcaggccaccggtgtgagcttcactatggaccaggacaccaccctagcgcacctgctgcagctccagctgcaccactatgaggatgaggtccggggcattgtggacaaagctgcaaaagagatgggtatggagaaaaccttaaaggagctgcagactacctgggctggcatggaattccagtatgagccccacccacggaccaatgtccccctcctgtgctctgatgaggacctcatagaggttctggaggataatcaagttcaacttcagaacctggtgatgtccaagtatgttgctttcttcttggaggaggtgtcgggctggcagaagaagctgtccacagtggacgctgtcatctctatctggtttgaagtgcagcgaacatggactcacctggaaagcatattcactggatctgaagatattcgggcacagctaccccaggattctaaaaggtttgaaggcatcgacattgactttaaagagctagcttatgatgcccagaaaattccaaatgtagtgcaaaccaccaacaagccaggcctgtatgaaaagctggaggatattcagggcagattgtgcctgtgtgagaaggccctggcagagtacctcgacaccaagaggcttgccttcccgcggttttactttctctcctcctccgatctgttagacatcctttccaacggcacagctccacaacaggttcaacgtcacctttccaaactctttgacaacatggccaagatgcgattccagctagatgccagtggggaaccaaccaagacaagcctcggcatgtacagcaaagaagaggagtatgtggctttcagtgagccctgtgactgcagcgggcaggtagaaatatggctgaaccatgtccttggtcacatgaaggccactgtgaggcatgagatgacagaaggtgtaactgcctatgaagaaaagccgagggagcagtggctttttgaccacccagctcaggtggccctgacctgtactcagatctggtggacaacagaagtgggcatggcatttgccaggctggaggaaggctatgagagtgccatgaaggactattataagaagcaagtggcccagctcaaaacccttatcaccatgctgattggccagctctccaagggagaccggcagaagattatgactatatgcaccatcgatgtgcatgcccgggatgtggtagccaagatgattgctcagaaggtagacaatgcccaggctttcctctggctgtctcagctgcgccatcgttgggatgacgaggtcaaacactgctttgccaacatctgtgatgcccagtttttgtattcctatgagtacctgggaaacacacctcgcttggtgatcacacctttgactgacaggtgctacatcaccctcacccagtccctgcacctgaccatgagtggggctcccgcaggacctgcaggcacaggcaagaccgagaccaccaaggacctgggccgcgcactgggcatcctggtctatgtgttcaactgctcggagcagatggattacaagtcttgtggcaacatctacaaaggccttgctcagactggtgcctggggctgctttgatgagtttaatcgaatctccgtggaggtcttgtcagtggtggcagtgcaggtaaaaagcattcaagatgcgattagagataagaagcagtggttcagcttccttggggaggagatcagcctgaatccttctgtcggtatcttcatcaccatgaacccaggctatgctggccgcacagagctgccagagaatctcaagtctctcttcaggccttgtgcaatggtggttccagactttgaattgatctgtgaaatcatgctggtggcagaaggattcattgaagcccagtcattagccagaaagttcatcactctttaccagttgtgcaaagagcttctctccaaacaggatcactacgactggggcctacgggccatcaagtccgtgctggtggtggcaggatccctgaagagaggagaccctgaccggcctgaggaccaggtcctgatgcgctccttgcgggatttcaacatccccaagattgtgactgatgacatgcccatcttcatgggcctgatcggggacctctttcccgccctggatgtcccccggaggagagaccccaacttcgaagctttggttaggaaggcgatagtggatctgaagctccaggctgaggacaactttgtgctcaaggtggtccagctggaggagctcctggctgtgcggcactctgtatttgtggtgggtggcgctggtaccggcaagtcacaggtgctgaggtccttgcacaagacctatcagatcatgaaacggcgccccgtctggactgacctcaatcccaaagcagtcacaaatgatgagctctttggcatcatcaatccagccacaggagaatggaaggatggattgttctcttccatcatgcgggagcttgccaacatcacccatgatgggcccaagtggattttactggatggcgacatagatccaatgtggattgaatccctgaatactgtcatggatgataacaaggtgctgacattggccagcaatgagaggattcctctgaaccccaccatgaagctcctctttgagatcagccacctgcgcacagccactccagcaactgtctctagagcagggatcttgtacatcaacccggcagacttgggatggaaccctccagtgagcagctggattgagaagagggaaatccagacagagagagccaacttaaccattttgttcgacaagtatcttccaacctgcctagacacactcagaaccaggtttaagaagatcattcccatcccagagcagagcatggttcagatggtgtgtcaccttctggaatgtctcctgaccacggaggacatccctgcagactgccctaaggaaatttatgagcattattttgtgtttgctgccatctgggctttcggcggagcaatggtccaagatcagcttgtggactaccgggcagagttcagcaaatggtggctgactgagttcaaaacagtcaagtttccttcccaaggaaccatctttgactattacatcgacccagagaccaagaaattcgagccttggtccaagctcgtcccccagttcgaatttgaccccgagatgcccttgcaggcgtgtttggtgcacacgagtgagaccatccgtgtgtgctacttcatggagcggttgatggcgcggcagcggcctgtcatgctggtgggcacggctggcactggcaagtcggtgctggtgggagctaagctggccagccttgaccccgaggcatacctggtgaaaaacgtgccattcaactactacaccacgtcagcaatgctgcaggctgtcctggagaagcctctggaaaagaaggctggcagaaactatggccctccagggaacaagaaactcatctatttcattgatgacatgaacatgcctgaggtggatgcctacgggacggtgcagccccacaccatcatccggcagcatctggactatggccactggtatgatcggagcaagctgtccctaaaggagatcacaaatgtacagtatgtttcctgtatgaaccccacggcaggcagcttcaccatcaacccccggcttcagcgtcacttcagcgtgtttgtcctctccttcccgggggcagatgccctgtcctctatctacagcatcatcctcactcagcatctgaagctcggaaacttcccggcgtccctgcagaaatccatccccccactgatcgatctggccctcgccttccaccagaaaattgctaccaccttcctacccacaggaatcaaattccactacatcttcaacctcagagattttgccaacattttccagggcattctcttctcctcagtggaatgtgtgaaatccacatgggatcttataaggctctatctgcatgaatcaaatcgagtttatcgggataagatggtagaagaaaaggactttgatctttttgataaaatccagacagaagtgctcaagaaaacttttgatgatattgaagaccctgtggagcagacccaaagcccgaacctgtattgtcactttgcaaatggtattggggagcccaaatacatgcctgtacagtcttgggaacttttgacccagactctggtggaggccttggagaaccacaatgaagtcaacacagtgatggacctagttctctttgaggatgccatgcgccatgtctgccatatcaatcgcatcttggagtccccgcggggaaatgctctgctggttggtgtaggtgggagcggcaagcagagcctgacaaggctggcagctttcatcagctccatggatgtcttccagatcacactgcgcaaaggctaccagatccaggacttcaagatggacctggccagcctgtgtctgaaagctggagtgaagaatctcaacacagtgtttctcatgactgatgcccaagtggctgatgagaggttccttgtgctcatcaatgatcttttggcatctggggagatcccagatctctactctgatgatgaagttgaaaacatcataagcaatgtgaggaatgaagtcaagagccagggtctggttgacaacagagagaactgttggaagttctttatagatcggatccggcgacagctgaaggtgactctctgtttctcccctgtgggaaacaagctaagagtccgcagcaggaagttcccagccattgtgaactgcacagccatccactggttccacgagtggcctcagcaagcattggagtctgtcagcctccgcttcttgcagaacacagagggcattgagcccacagtaaagcagtcgattagcaaattcatggcctttgtccacacaagtgtcaaccaaacatcccagtcttatctgagcaatgaacagcgctacaactatacaactcccaagtcctttctggagttcatcagactctaccagagcttgttgcacaggcacagaaaagagctcaagtgcaagacagagcggttggagaacgggctgctgaagctgcatagcacctctgcccaggtggatgatctgaaagcaaagctggctgcccaggaagtagagctgaagcagaaaaatgaagatgcagacaaactgattcaggtcgtgggtgtggagactgacaaagtgagcagagagaaagccatggcagatgaagaggagcagaaggtggccgtcatcatgctagaggtgaaacagaagcagaaggactgtgaggaggacctggcaaaggctgagccagcactcacagcagcgcaggcagctctcaacaccctgaacaagaccaacctgacagagctgaagtcatttggctctccgcctctggccgtcagcaatgtcagcgctgcggtgatggtactgatggctcccaggggtagggtgcccaaggaccggagctggaaggctgctaaggtcaccatggccaaagtggatggcttcctggactcgctaataaacttcaacaaagagaacattcacgagaactgcctcaaagccatcaggccgtatctgcaagacccggagttcaatcctgagtttgtggccaccaaatcctatgcggctgcaggcctctgctcctgggtcatcaatattgtgagattttatgaggtgttctgtgatgtggaacccaagcgccaggcactgaacaaagccaccgcggacctcacagctgcccaggagaagctggctgccatcaaagccaagatcgctcaccttaatgaaaacctggcaaagctcacagccaggtttgagaaagcaacagcagacaaactcaaatgtcagcaagaagccgaagtgaccgcagtcaccatctcccttgccaaccgcctggttggaggactcgcttctgaaaacgtgaggtgggcagatgccgtgcagaacttcaaacagcaggaaaggacgttatgtggagacattttacttataacggctttcatttcctaccttggcttcttcacaaagaaataccggcagagcctcctggacagaacttggaggccctacctgagccagctgaaaactcccattccagtcaccccagccctggatcccctgaggatgctgatggatgatgctgacgtggctgcctggcagaacgagggcctcccagccgaccgcatgtccgtggagaatgccaccattctcatcaactgtgagcgctggccactcatggttgaccctcagctacaaggcatcaaatggatcaagaataaatatggtgaagatctccgggtcacgcagattggtcagaaaggctaccttcaaatcatagagcaggccctggaagctggagctgtggtgctgattgaaaatctagaggagtccattgatcctgttctgggacccctgcttgggagagaagtcattaaaaaaggacgattcattaaaattggagacaaagaatgtgaatacaatcccaagttccggctcatcctccacaccaagctggctaatcctcactaccagcctgagctgcaggctcaggccaccctgatcaacttcaccgtgaccagggatggcctggaggaccagttgctggccgctgtggtcagcatggagaggccagacttggagcagctgaagtccgatctcacaaagcagcagaatggattcaaaattaccctgaaaacgttggaagacagtcttctctctcgcctctcctccgcctctgggaacttcctgggagaaacagtgctggtggaaaacctagagatcaccaagcagactgctgccgaagttgagaaaaaggtccaggaggccaaggtgactgaagtgaaaatcaacgaggcccgagagcactaccggccagcagctgccagggcctcactgctctacttcatcatgaacgacctcagcaagatccatccaatgtaccagttttctctcaaggccttcagtatcgtcttccagaaggctgtggagagggctgctcctgacgaaagcctcagggagcgggtggccaacctaatagacagcataaccttctctgtgtaccagtacaccatccgcgggctctttgagtgtgataagctgacctaccttgcccagctcacctttcagattctcctcatgaaccgagaagtcaatgcagtggagttggatttcctgcttcgatctccagtgcagacgggcaccgccagccccgtggagttcctctcccatcaggcgtggggagctgtcaaggtactttcatcaatggaagaattctctaatctggatcgggacatagagggatctgctaagagctggaaaaagtttgtggagtccgaatgtcctgagaaagagaagctcccacaggagtggaagaacaagacagccctgcagcgcctctgcatgctgagagccatgcggcccgaccggatgacctatgctttgcgagattttgttgaagagaagttaggaagcaaatacgtggtgggaagagccctagattttgcaacctcatttgaagaatcgggaccagccactcctatgtttttcatcctgtctccaggggtggacccactgaaggatgtagaaagtcaaggaagaaaacttggatacaccttcaacaatcagaactttcacaacgtgtctttggggcaaggacaggaagtggtggctgaggctgcgctggacctcgctgccaagaaaggtcactgggttattttgcagaacattcacctggtggccaagtggctcagcaccctggagaagaagctggaggagcacagtgagaacagccacccagagttcagggtcttcatgagtgcagagccagcaccctcccctgagggccacatcatcccccagggcatcctggagaactccattaagatcaccaatgagccccccacgggcatgcatgccaacctgcacaaggccctggacaacttcactcaggacactctggagatgtgttctcgggagacggagtttaagagcatcctctttgctctttgttacttccatgcggtggtggcagaaagacgaaaatttgggccccagggatggaatcgctcatacccctttaacactggagacctcactatctctgtgaatgtcctctacaacttcctggaggccaacgcaaaggtcccctatgatgatttgcgctacctgtttggagagatcatgtatggaggccatatcacagatgactgggacagaagactctgcagaacctacctgggggaattcattcgaccagaaatgttagaaggagaactgtctttggccccagggttcccactcccaggcaacatggactacaatggttatcatcagtacatcgatgctgagctgcccccagaatccccctacctctatggcctccacccgaacgcagagattggcttcctgacccaaacctcagaaaagctcttccgcactgtgctggagctgcagcctcgggacagccaggccagagacggagcgggcgccacaagagaagaaaaggtcaaggcacttctggaagaaatattggagcgggtgacagacgagtttaacatcccagaactgatggccaaagtggaggagcgcaccccttacattgtagttgccttccaggagtgtggccggatgaatatcctcaccagagagattcagcgctcactgagggagctggagctcggcttaaagggggagctgactatgaccagccacatggagaacttacagaatgccctgtacttcgatatggtgccagagtcctgggctagacgagcctacccttccacagcaggcctggcagcctggtttccagacctcctcaacagaatcaaggagctagaggcttggacgggtgactttacaatgccctccactgtgtggctgacaggcttcttcaacccccagtcgttcctgactgccatcatgcagtccacggctcgcaagaatgagtggccactggaccagatggccctgcaatgtgacatgacgaagaagaacagagaagagtttaggagtcctcctcgggaaggggcctacatccatggcctcttcatggaaggtgcctgctgggacacacaggctgggatcattacagaggcaaagctgaaggatctgacaccccctatgcctgtgatgttcatcaaggccattcctgcagataagcaggactgccgcagtgtctattcctgtcctgtgtacaagactagtcagcggggacccacctacgtgtggactttcaacctgaagactaaggaaaacccatccaagtgggttctggctggagtagccttgcttctccagatttagcatcctgcagagccaccgagaaaataaaaaagctgggcttggaggctgcctagagggacaggtgggtgaagggtcaccacagacacttagaacggtaagaaaccatgagcactcacaattctgtagaattcctctagggaacttggagaggtgtgcctaaggtgaggctgagctgaaggaatgtgggcccaggtttcttaataaaatgatttactcttcaactgtgtctggcccaggatttgaganctgctgaatcataaatgatcatgtagagaccaagagaaaca

SEQ ID NO: 287556 - DNA, 13748 bp, Homo sapiens
agcagaggagtgagtcctggccgcgtccccgtcgctagggaaaccgatgcagctggaggccgcgcgcgatgcggctcgcggaggagcgggccgcgctcgcggcggagaacgcggatggggaacccggcgccgaccgacgactgcgactcctggggacctacgtggccatgagcctgcggccggctgcgggcgcctgggagcgttgcgcggggagtgctgaggcggagcagctgctccaggccttcctgggccgcgatgctgccgaggggccgcggccgctgctggtggtgcggcccgggcccaggggcctggcaatacgccccgggctggaggtgggacctgagtcgggcctggctggcgctaaggcgctttttttccttcgcaccgggcccgagcctccagggcccgacagcttccgcggcgcagtggtctgcggggacctgcccgcggcacctctggagcacctagccgcgctgttctcggaggttgttctacccgtcctggccaatgagaagaatcgcctaaactggccccacatgatatgtgaggatgtcaggcggcacgcccacagcctccaatgtgacctctcagttatacttgagcaagtgaagggaaaaactttgctgcctcttccagcaggctcagaaaaaatggagtttgcggattccaaaagtgagacagtcttggattctatagataagtcagtcatctatgccattgagtctgcagtgatcaaatggagctaccaagtccaggtggtactcaagagagagtcttcccagccactcttacaaggggagaatcccacccctaaggtggagttggagttctggaagagcaggtatgaagatctgaaatacatctataatcaactgagaacaataacggtgaggggcatggccaagctcctggacaagcttcagagtagctactttccagctttcaaagccatgtacagagatgttgttgcagctctagcagaggcacaggacatccatgtgcacctgataccgctccagcgccacctggaagctctggagaatgcagaatttccggaggtgaagccccagctgcggcccctgctccacgtggtctgtctgatttgggccacatgcaagtcctaccgctccccgggaaggctgactgtgctgctccaggagatttgcaaccttctcatccagcaggcctctaattatctcagcccagaagacctgctgagaagtgaggtagaagaaagtcagagaaaactgcaagtggtctcagacactttgagcttcttcaagcaagagtttcaggacagaagggagaatctccacacttacttcaaagagaaccaggaagtcaaggaatgggatttccagtcttctttggtctttgtgcgattggatggcttcctgggacgactgcacgtggtggagggtcttctgaagacggccctggatttccacaaactgggaaaggtggagttcagcggcgtcagagggaatgctctgagtcagcaggtccagcaaatgcatgaagaatttcaagagatgtacaggcttctctcaggatcctcctccgactgcctgtacctccaaagcacggactttgaaaatgacgtctctgaatttaaccagaaagtagaagatcttgaccgaagattggggactatctttattcaagcttttgatgatgcacctggcttggagcatgcctttaagctgctagacatagcaggaaacctccttgaaagaccgctggtagcgagggatacatctgataaatacctggtcctcatccaaatgttcaacaaagatctggatgcagtgaggatgatctacagtcagcacgtccaggaggaagcagaacttgggttctccccggtgcacaagaacatgcccaccgtggctggcggcctccgctgggcacaggagctgaggcagcgcatccagggtcctttcagcaactttggacgcatcacacacccttgcatggaatctgcagaaggaaagcgaatgcaacaaaaatatgaagatatgctgtcattgctagaaaagtatgagacaagactttatgaggattggtgccggacagtatcagagaagtcacagtacaatctttcccaaccacttctaaaacgtgacccagagacgaaggagatcactatcaactttaacccacagctgatttcagtgctgaaagaaatgagctatcttgaacccagagagatgaaacacatgcctgagacagcagcagccatgttctcctccagggatttctatcggcagcttgtggctaatttagagttgatggcaaattggtacaacaaggttatgaaaactctgctggaggtggaatttccattagtggaggaagagctgcaaaatattgatctccgcctcagagcagcagaggagactttgaactggaaaacagaaggcatttgcgattatgtcactgaaatcaccagtagtattcatgatcttgaacaaagaattcagaaaactaaagacaatgtggaagagatccaaaacatcatgaaaacatgggtgactccaatatttaagacaaaagatggaaaaagggaatcccttctttctctggatgatcggcatgatcgaatggaaaaatattacaatctcatcaaggaatctggccttaagatccacgcccttgttcaggaaaacctgggtctattttcagcagacccaacctccaatatctggaagacttatgttaactctattgacaatttgttgctgaatggattctttcttgccattgagtgctccctcaagtatcttctggaaaatactgagtgtaaggcaggacttaccccaatatttgaagcacaactgagtctagccatcccagagctagttttctatccgtctctggagtctggagtgaaggggggtttctgtgacattgttgagggtctcatcaccagcatttttaggataccatctctggtgccacggctttccccacaaaatggctctcctcactatcaggtcgacctggacggtataccagatttggcaaacatgcggcgcacactcatggagagagtccagagaatgatgggcctctgctgtggctatcagagcaccttcagccagtattcgtacctctatgtggaggaccggaaggaggttctgggtcagtttctgctgtacgggcacatcctcactccggaagaaattgaagaccatgtggaagatggcatcccagagaaccctcccctcctttctcagtttaaagtgcaaatcgactcctatgaaacgctctatgaagaggtgtgcaggctggaacccatcaaggtgtttgacggctggatgaaaattgatattcgaccctttaaggcatctctgctgaatattattaagaggtggagcctcctgttcaaacagcatcttgtggaccacgtcactcacagcttggccaacctggacgcgtttataaagaagagtgagagcggcttactcaagaaagttgaaaaaggagatttccaaggcttggttgagatcatgggacaccttatggctgttaaagaacggcagagtaacactgatgagatgtttgagcccttaaagcagactattgaattgctgaagacctatgaacaagaattgccagaaacagtgtttaagcagctggaggagctgcctgagaaatggaacaacataaaaaaggtggccattactgtgaagcagcaggtggccccactgcaggcaaatgaagtgacactcctccgccagaggtgcacagccttcgatgcagaacagcagcaattctgggagcaattccacaaagaagccccgttcaggtttgatagcatccaccctcatcaaatgctggatgccaggcacatcgagatccagcagatggaatccactatggcctccatttctgagtctgccagcttatttgaagtcaatgtccctgactataagcagctgaggcagtgcaggaaggaggtctgccagctgaaggagctctgggacaccattggaatggtgacctccagcatccatgcctgggagaccacaccctggaggaatatcaacgtggaagccatggagttggagtgcaaacagtttgcccggcatatccgaaacctggacaaggaggtcagggcctgggatgcattcacaggcctggaaagcactgtgtggaacacgctgagctccctgagggcagtagctgagctgcagaatccagccatccgggagcggcactggaggcagctgatgcaggccaccggtgtgagcttcactatggaccaggacaccaccctagcgcacctgctgcagctccagctgcaccactatgaggatgaggtccggggcattgtggacaaagctgcaaaagagatgggtatggagaaaaccttaaaggagctgcagactacctgggctggcatggaattccagtatgagccccacccacggaccaatgtccccctcctgtgctctgatgaggacctcatagaggttctggaggataatcaagttcaacttcagaacctggtgatgtccaagtatgttgctttcttcttggaggaggtgtcgggctggcagaagaagctgtccacagtggacgctgtcatctctatctggtttgaagtgcagcgaacatggactcacctggaaagcatattcactggatctgaagatattcgggcacagctaccccaggattctaaaaggtttgaaggcatcgacattgactttaaagagctagcttatgatgcccagaaaattccaaatgtagtgcaaaccaccaacaagccaggcctgtatgaaaagctggaggatattcagggcagattgtgcctgtgtgagaaggccctggcagagtacctcgacaccaagaggcttgccttcccgcggttttactttctctcctcctccgatctgttagacatcctttccaacggcacagctccacaacaggttcaacgtcacctttccaaactctttgacaacatggccaagatgcgattccagctagatgccagtggggaaccaaccaagacaagcctcggcatgtacagcaaagaagaggagtatgtggctttcagtgagccctgtgactgcagcgggcaggtagaaatatggctgaaccatgtccttggtcacatgaaggccactgtgaggcatgagatgacagaaggtgtaactgcctatgaagaaaagccgagggagcagtggctttttgaccacccagctcaggtggccctgacctgtactcagatctggtggacaacagaagtgggcatggcatttgccaggctggaggaaggctatgagagtgccatgaaggactattataagaagcaagtggcccagctcaaaacccttatcaccatgctgattggccagctctccaagggagaccggcagaagattatgactatatgcaccatcgatgtgcatgcccgggatgtggtagccaagatgattgctcagaaggtagacaatgcccaggctttcctctggctgtctcagctgcgccatcgttgggatgacgaggtcaaacactgctttgccaacatctgtgatgcccagtttttgtattcctatgagtacctgggaaacacacctcgcttggtgatcacacctttgactgacaggtgctacatcaccctcacccagtccctgcacctgaccatgagtggggctcccgcaggacctgcaggcacaggcaagaccgagaccaccaaggacctgggccgcgcactgggcatcctggtctatgtgttcaactgctcggagcagatggattacaagtcttgtggcaacatctacaaaggccttgctcagactggtgcctggggctgctttgatgagtttaatcgaatctccgtggaggtcttgtcagtggtggcagtgcaggtaaaaagcattcaagatgcgattagagataagaagcagtggttcagcttccttggggaggagatcagcctgaatccttctgtcggtatcttcatcaccatgaacccaggctatgctggccgcacagagctgccagagaatctcaagtctctcttcaggccttgtgcaatggtggttccagactttgaattgatctgtgaaatcatgctggtggcagaaggattcattgaagcccagtcattagccagaaagttcatcactctttaccagttgtgcaaagagcttctctccaaacaggatcactacgactggggcctacgggccatcaagtccgtgctggtggtggcaggatccctgaagagaggagaccctgaccggcctgaggaccaggtcctgatgcgctccttgcgggatttcaacatccccaagattgtgactgatgacatgcccatcttcatgggcctgatcggggacctctttcccgccctggatgtcccccggaggagagaccccaacttcgaagctttggttaggaaggcgatagtggatctgaagctccaggctgaggacaactttgtgctcaaggtggtccagctggaggagctcctggctgtgcggcactctgtatttgtggtgggtggcgctggtaccggcaagtcacaggtgctgaggtccttgcacaagacctatcagatcatgaaacggcgccccgtctggactgacctcaatcccaaagcagtcacaaatgatgagctctttggcatcatcaatccagccacaggagaatggaaggatggattgttctcttccatcatgcgggagcttgccaacatcacccatgatgggcccaagtggattttactggatggcgacatagatccaatgtggattgaatccctgaatactgtcatggatgataacaaggtgctgacattggccagcaatgagaggattcctctgaaccccaccatgaagctcctctttgagatcagccacctgcgcacagccactccagcaactgtctctagagcagggatcttgtacatcaacccggcagacttgggatggaaccctccagtgagcagctggattgagaagagggaaatccagacagagagagccaacttaaccattttgttcgacaagtatcttccaacctgcctagacacactcagaaccaggtttaagaagatcattcccatcccagagcagagcatggttcagatggtgtgtcaccttctggaatgtctcctgaccacggaggacatccctgcagactgccctaaggaaatttatgagcattattttgtgtttgctgccatctgggctttcggcggagcaatggtccaagatcagcttgtggactaccgggcagagttcagcaaatggtggctgactgagttcaaaacagtcaagtttccttcccaaggaaccatctttgactattacatcgacccagagaccaagaaattcgagccttggtccaagctcgtcccccagttcgaatttgaccccgagatgcccttgcaggcgtgtttggtgcacacgagtgagaccatccgtgtgtgctacttcatggagcggttgatggcgcggcagcggcctgtcatgctggtgggcacggctggcactggcaagtcggtgctggtgggagctaagctggccagccttgaccccgaggcatacctggtgaaaaacgtgccattcaactactacaccacgtcagcaatgctgcaggctgtcctggagaagcctctggaaaagaaggctggcagaaactatggccctccagggaacaagaaactcatctatttcattgatgacatgaacatgcctgaggtggatgcctacgggacggtgcagccccacaccatcatccggcagcatctggactatggccactggtatgatcggagcaagctgtccctaaaggagatcacaaatgtacagtatgtttcctgtatgaaccccacggcaggcagcttcaccatcaacccccggcttcagcgtcacttcagcgtgtttgtcctctccttcccgggggcagatgccctgtcctctatctacagcatcatcctcactcagcatctgaagctcggaaacttcccggcgtccctgcagaaatccatccccccactgatcgatctggccctcgccttccaccagaaaattgctaccaccttcctacccacaggaatcaaattccactacatcttcaacctcagagattttgccaacattttccagggcattctcttctcctcagtggaatgtgtgaaatccacatgggatcttataaggctctatctgcatgaatcaaatcgagtttatcgggataagatggtagaagaaaaggactttgatctttttgataaaatccagacagaagtgctcaagaaaacttttgatgatattgaagaccctgtggagcagacccaaagcccgaacctgtattgtcactttgcaaatggtattggggagcccaaatacatgcctgtacagtcttgggaacttttgacccagactctggtggaggccttggagaaccacaatgaagtcaacacagtgatggacctagttctctttgaggatgccatgcgccatgtctgccatatcaatcgcatcttggagtccccgcggggaaatgctctgctggttggtgtaggtgggagcggcaagcagagcctgacaaggctggcagctttcatcagctccatggatgtcttccagatcacactgcgcaaaggctaccagatccaggacttcaagatggacctggccagcctgtgtctgaaagctggagtgaagaatctcaacacagtgtttctcatgactgatgcccaagtggctgatgagaggttccttgtgctcatcaatgatcttttggcatctggggagatcccagatctctactctgatgatgaagttgaaaacatcataagcaatgtgaggaatgaagtcaagagccagggtctggttgacaacagagagaactgttggaagttctttatagatcggatccggcgacagctgaaggtgactctctgtttctcccctgtgggaaacaagctaagagtccgcagcaggaagttcccagccattgtgaactgcacagccatccactggttccacgagtggcctcagcaagcattggagtctgtcagcctccgcttcttgcagaacacagagggcattgagcccacagtaaagcagtcgattagcaaattcatggcctttgtccacacaagtgtcaaccaaacatcccagtcttatctgagcaatgaacagcgctacaactatacaactcccaagtcctttctggagttcatcagactctaccagagcttgttgcacaggcacagaaaagagctcaagtgcaagacagagcggttggagaacgggctgctgaagctgcatagcacctctgcccaggtggatgatctgaaagcaaagctggctgcccaggaagtagagctgaagcagaaaaatgaagatgcagacaaactgattcaggtcgtgggtgtggagactgacaaagtgagcagagagaaagccatggcagatgaagaggagcagaaggtggccgtcatcatgctagaggtgaaacagaagcagaaggactgtgaggaggacctggcaaaggctgagccagcactcacagcagcgcaggcagctctcaacaccctgaacaagaccaacctgacagagctgaagtcatttggctctccgcctctggccgtcagcaatgtcagcgctgcggtgatggtactgatggctcccaggggtagggtgcccaaggaccggagctggaaggctgctaaggtcaccatggccaaagtggatggcttcctggactcgctaataaacttcaacaaagagaacattcacgagaactgcctcaaagccatcaggccgtatctgcaagacccggagttcaatcctgagtttgtggccaccaaatcctatgcggctgcaggcctctgctcctgggtcatcaatattgtgagattttatgaggtgttctgtgatgtggaacccaagcgccaggcactgaacaaagccaccgcggacctcacagctgcccaggagaagctggctgccatcaaagccaagatcgctcaccttaatgaaaacctggcaaagctcacagccaggtttgagaaagcaacagcagacaaactcaaatgtcagcaagaagccgaagtgaccgcagtcaccatctcccttgccaaccgcctggttggaggactcgcttctgaaaacgtgaggtgggcagatgccgtgcagaacttcaaacagcaggaaaggacgttatgtggagacattttacttataacggctttcatttcctaccttggcttcttcacaaagaaataccggcagagcctcctggacagaacttggaggccctacctgagccagctgaaaactcccattccagtcaccccagccctggatcccctgaggatgctgatggatgatgctgacgtggctgcctggcagaacgagggcctcccagccgaccgcatgtccgtggagaatgccaccattctcatcaactgtgagcgctggccactcatggttgaccctcagctacaaggcatcaaatggatcaagaataaatatggtgaagatctccgggtcacgcagattggtcagaaaggctaccttcaaatcatagagcaggccctggaagctggagctgtggtgctgattgaaaatctagaggagtccattgatcctgttctgggacccctgcttgggagagaagtcattaaaaaaggacgattcattaaaattggagacaaagaatgtgaatacaatcccaagttccggctcatcctccacaccaagctggctaatcctcactaccagcctgagctgcaggctcaggccaccctgatcaacttcaccgtgaccagggatggcctggaggaccagttgctggccgctgtggtcagcatggagaggccagacttggagcagctgaagtccgatctcacaaagcagcagaatggattcaaaattaccctgaaaacgttggaagacagtcttctctctcgcctctcctccgcctctgggaacttcctgggagaaacagtgctggtggaaaacctagagatcaccaagcagactgctgccgaagttgagaaaaaggtccaggaggccaaggtgactgaagtgaaaatcaacgaggcccgagagcactaccggccagcagctgccagggcctcactgctctacttcatcatgaacgacctcagcaagatccatccaatgtaccagttttctctcaaggccttcagtatcgtcttccagaaggctgtggagagggctgctcctgacgaaagcctcagggagcgggtggccaacctaatagacagcataaccttctctgtgtaccagtacaccatccgcgggctctttgagtgtgataagctgacctaccttgcccagctcacctttcagattctcctcatgaaccgagaagtcaatgcagtggagttggatttcctgcttcgatctccagtgcagacgggcaccgccagccccgtggagttcctctcccatcaggcgtggggagctgtcaaggtactttcatcaatggaagaattctctaatctggatcgggacatagagggatctgctaagagctggaaaaagtttgtggagtccgaatgtcctgagaaagagaagctcccacaggagtggaagaacaagacagccctgcagcgcctctgcatgctgagagccatgcggcccgaccggatgacctatgctttgcgagattttgttgaagagaagttaggaagcaaatacgtggtgggaagagccctagattttgcaacctcatttgaagaatcgggaccagccactcctatgtttttcatcctgtctccaggggtggacccactgaaggatgtagaaagtcaaggaagaaaacttggatacaccttcaacaatcagaactttcacaacgtgtctttggggcaaggacaggaagtggtggctgaggctgcgctggacctcgctgccaagaaaggtcactgggttattttgcagaacattcacctggtggccaagtggctcagcaccctggagaagaagctggaggagcacagtgagaacagccacccagagttcagggtcttcatgagtgcagagccagcaccctcccctgagggccacatcatcccccagggcatcctggagaactccattaagatcaccaatgagccccccacgggcatgcatgccaacctgcacaaggccctggacaacttcactcaggacactctggagatgtgttctcgggagacggagtttaagagcatcctctttgctctttgttacttccatgcggtggtggcagaaagacgaaaatttgggccccagggatggaatcgctcatacccctttaacactggagacctcactatctctgtgaatgtcctctacaacttcctggaggccaacgcaaaggtcccctatgatgatttgcgctacctgtttggagagatcatgtatggaggccatatcacagatgactgggacagaagactctgcagaacctacctgggggaattcattcgaccagaaatgttagaaggagaactgtctttggccccagggttcccactcccaggcaacatggactacaatggttatcatcagtacatcgatgctgagctgcccccagaatccccctacctctatggcctccacccgaacgcagagattggcttcctgacccaaacctcagaaaagctcttccgcactgtgctggagctgcagcctcgggacagccaggccagagacggagcgggcgccacaagagaagaaaaggtcaaggcacttctggaagaaatattggagcgggtgacagacgagtttaacatcccagaactgatggccaaagtggaggagcgcaccccttacattgtagttgccttccaggagtgtggccggatgaatatcctcaccagagagattcagcgctcactgagggagctggagctcggcttaaagggggagctgactatgaccagccacatggagaacttacagaatgccctgtacttcgatatggtgccagagtcctgggctagacgagcctacccttccacagcaggcctggcagcctggtttccagacctcctcaacagaatcaaggagctagaggcttggacgggtgactttacaatgccctccactgtgtggctgacaggcttcttcaacccccagtcgttcctgactgccatcatgcagtccacggctcgcaagaatgagtggccactggaccagatggccctgcaatgtgacatgacgaagaagaacagagaagagtttaggagtcctcctcgggaaggggcctacatccatggcctcttcatggaaggtgcctgctgggacacacaggctgggatcattacagaggcaaagctgaaggatctgacaccccctatgcctgtgatgttcatcaaggccattcctgcagataagcaggactgccgcagtgtctattcctgtcctgtgtacaagactagtcagcggggacccacctacgtgtggactttcaacctgaagactaaggaaaacccatccaagtgggttctggctggagtagccttgcttctccagatttagcatcctgcagagccaccgagaaaataaaaaagctgggcttggaggctgcctagagggacaggtgggtgaagggtcaccacagacacttagaacggtaagaaaccatgagcactcacaattctgtagaattcctctagggaacttggagaggtgtgcctaaggtgaggctgagctgaaggaatgtgggcccaggtttcttaataaaatgatttactcttc

SEQ ID NO: 287557 - DNA, 3145 bp, Homo sapiens
tcgtgttaagaaacaagaaaggtcagggtggctgtggttggaacctccaacaggaaggttattcttcccacggatccaaaggctgtacaagggcaaagacactacagctgcctgaagttagtgctttaggatatggagcataaagagaggaaaagatgagatccacttggataccagcaccccactccagcctcgaggaagcttttacacagtctgccatggttttacacagtttaaaactggaagacagattctgctgattttcttttaatccgatctcacaaagcagcagaatggattcaaaattaccctgaaaacgttggaagacagtcttctctctcgcctctcctccgcctctgggaacttcctgggagaaacagtgctggtggaaaacctagagatcaccaagcagactgctgccgaagttgagaaaaaggtccaggaggccaaggtgactgaagtgaaaatcaacgaggcccgagagcactaccggccagcagctgccagggcctcactgctctacttcatcatgaacgacctcagcaagatccatccaatgtaccagttttctctcaaggccttcagtatcgtcttccagaaggctgtggagagggctgctcctgacgaaagcctcagggagcgggtggccaacctaatagacagcataaccttctctgtgtaccagtacaccatccgcgggctctttgagtgtgataagctgacctaccttgcccagctcacctttcagattctcctcatgaaccgagaagtcaatgcagtggagttggatttcctgcttcgatctccagtgcagacgggcaccgccagccccgtggagttcctctcccatcaggcgtggggagctgtcaaggtactttcatcaatggaagaattctctaatctggatcgggacatagagggatctgctaagagctggaaaaagtttgtggagtccgaatgtcctgagaaagagaagctcccacaggagtggaagaacaagacagccctgcagcgcctctgcatgctgagagccatgcggcccgaccggatgacctatgctttgcgagattttgttgaagagaagttaggaagcaaatacgtggtgggaagagccctagattttgcaacctcatttgaagaatcgggaccagccactcctatgtttttcatcctgtctccaggggtggacccactgaaggatgtagaaagtcaaggaagaaaacttggatacaccttcaacaatcagaactttcacaacgtgtctttggggcaaggacaggaagtggtggctgaggctgcgctggacctcgctgccaagaaaggtcactgggttattttgcagaacattcacctggtggccaagtggctcagcaccctggagaagaagctggaggagcacagtgagaacagccacccagagttcagggtcttcatgagtgcagagccagcaccctcccctgagggccacatcatcccccagggcatcctggagaactccattaagatcaccaatgagccccccacgggcatgcatgccaacctgcacaaggccctggacaacttcactcaggacactctggagatgtgttctcgggagacggagtttaagagcatcctctttgctctttgttacttccatgcggtggtggcagaaagacgaaaatttgggccccagggatggaatcgctcatacccctttaacactggagacctcactatctctgtgaatgtcctctacaacttcctggaggccaacgcaaaggtcccctatgatgatttgcgctacctgtttggagagatcatgtatggaggccatatcacagatgactgggacagaagactctgcagaacctacctgggggaattcattcgaccagaaatgttagaaggagaactgtctttggccccagggttcccactcccaggcaacatggactacaatggttatcatcagtacatcgatgctgagctgcccccagaatccccctacctctatggcctccacccgaacgcagagattggcttcctgacccaaacctcagaaaagctcttccgcactgtgctggagctgcagcctcgggacagccaggccagagacggagcgggcgccacaagagaagaaaaggtcaaggcacttctggaagaaatattggagcgggtgacagacgagtttaacatcccagaactgatggccaaagtggaggagcgcaccccttacattgtagttgccttccaggagtgtggccggatgaatatcctcaccagagagattcagcgctcactgagggagctggagctcggcttaaagggggagctgactatgaccagccacatggagaacttacagaatgccctgtacttcgatatggtgccagagtcctgggctagacgagcctacccttccacagcaggcctggcagcctggtttccagacctcctcaacagaatcaaggagctagaggcttggacgggtgactttacaatgccctccactgtgtggctgacaggcttcttcaacccccagtcgttcctgactgccatcatgcagtccacggctcgcaagaatgagtggccactggaccagatggccctgcaatgtgacatgacgaagaagaacagagaagagtttaggagtcctcctcgggaaggggcctacatccatggcctcttcatggaaggtgcctgctgggacacacaggctgggatcattacagaggcaaagctgaaggatctgacaccccctatgcctgtgatgttcatcaaggccattcctgcagataagcaggactgccgcagtgtctattcctgtcctgtgtacaagactagtcagcggggacccacctacgtgtggactttcaacctgaagactaaggaaaacccatccaagtgggttctggctggagtagccttgcttctccagatttagcatcctgcagagccaccgagaaaataaaaaagctgggcttggaggctgcctagagggacaggtgggtgaagggtcaccacagacacttagaacggtaagaaaccatgagcactcacaattctgtagaattcctctagggaacttggagaggtgtgcctaaggtgaggctgagctgaaggaatgtgggcccaggtttcttaataaaatgatttactcttc

SEQ ID NO: 287558 - DNA, 13520 bp, Homo sapiens
agcagaggagtgagtcctggccgcgtccccgtcgctagggaaaccgatgcagctggaggccgcgcgcgatgcggctcgcggaggagcgggccgcgctcgcggcggagaacgcggatggggaacccggcgccgaccgacgactgcgactcctggggacctacgtggccatgagcctgcggccggctgcgggcgcctgggagcgttgcgcggggagtgctgaggcggagcagctgctccaggccttcctgggccgcgatgctgccgaggggccgcggccgctgctggtggtgcggcccgggcccaggggcctggcaatacgccccgggctggaggtgggacctgagtcgggcctggctggcgctaaggcgctttttttccttcgcaccgggcccgagcctccagggcccgacagcttccgcggcgcagtggtctgcggggacctgcccgcggcacctctggagcacctagccgcgctgttctcggaggttgttctacccgtcctggccaatgagaagaatcgcctaaactggccccacatgatatgtgaggatgtcaggcggcacgcccacagcctccaatgtgacctctcagttatacttgagcaagtgaagggaaaaactttgctgcctcttccagcaggctcagaaaaaatggagtttgcggattccaaaagtgagacagtcttggattctatagataagtcagtcatctatgccattgagtctgcagtgatcaaatggagctaccaagtccaggtggtactcaagagagagtcttcccagccactcttacaaggggagaatcccacccctaaggtggagttggagttctggaagagcaggtatgaagatctgaaatacatctataatcaactgagaacaataacggtgaggggcatggccaagctcctggacaagcttcagagtagctactttccagctttcaaagccatgtacagagatgttgttgcagctctagcagaggcacaggacatccatgtgcacctgataccgctccagcgccacctggaagctctggagaatgcagaatttccggaggtgaagccccagctgcggcccctgctccacgtggtctgtctgatttgggccacatgcaagtcctaccgctccccgggaaggctgactgtgctgctccaggagatttgcaaccttctcatccagcaggcctctaattatctcagcccagaagacctgctgagaagtgaggtagaagaaagtcagagaaaactgcaagtggtctcagacactttgagcttcttcaagcaagagtttcaggacagaagggagaatctccacacttacttcaaagagaaccaggaagtcaaggaatgggatttccagtcttctttggtctttgtgcgattggatggcttcctgggacgactgcacgtggtggagggtcttctgaagacggccctggatttccacaaactgggaaaggtggagttcagcggcgtcagagggaatgctctgagtcagcaggtccagcaaatgcatgaagaatttcaagagatgtacaggcttctctcaggatcctcctccgactgcctgtacctccaaagcacggactttgaaaatgacgtctctgaatttaaccagaaagtagaagatcttgaccgaagattggggactatctttattcaagcttttgatgatgcacctggcttggagcatgcctttaagctgctagacatagcaggaaacctccttgaaagaccgctggtagcgagggatacatctgataaatacctggtcctcatccaaatgttcaacaaagatctggatgcagtgaggatgatctacagtcagcacgtccaggaggaagcagaacttgggttctccccggtgcacaagaacatgcccaccgtggctggcggcctccgctgggcacaggagctgaggcagcgcatccagggtcctttcagcaactttggacgcatcacacacccttgcatggaatctgcagaaggaaagcgaatgcaacaaaaatatgaagatatgctgtcattgctagaaaagtatgagacaagactttatgaggattggtgccggacagtatcagagaagtcacagtacaatctttcccaaccacttctaaaacgtgacccagagacgaaggagatcactatcaactttaacccacagctgatttcagtgctgaaagaaatgagctatcttgaacccagagagatgaaacacatgcctgagacagcagcagccatgttctcctccagggatttctatcggcagcttgtggctaatttagagttgatggcaaattggtacaacaaggttatgaaaactctgctggaggtggaatttccattagtggaggaagagctgcaaaatattgatctccgcctcagagcagcagaggagactttgaactggaaaacagaaggcatttgcgattatgtcactgaaatcaccagtagtattcatgatcttgaacaaagaattcagaaaactaaagacaatgtggaagagatccaaaacatcatgaaaacatgggtgactccaatatttaagacaaaagatggaaaaagggaatcccttctttctctggatgatcggcatgatcgaatggaaaaatattacaatctcatcaaggaatctggccttaagatccacgcccttgttcaggaaaacctgggtctattttcagcagacccaacctccaatatctggaagacttatgttaactctattgacaatttgttgctgaatggattctttcttgccattgagtgctccctcaagtatcttctggaaaatactgagtgtaaggcaggacttaccccaatatttgaagcacaactgagtctagccatcccagagctagttttctatccgtctctggagtctggagtgaaggggggtttctgtgacattgttgagggtctcatcaccagcatttttaggataccatctctggtgccacggctttccccacaaaatggctctcctcactatcaggtcgacctggacggtataccagatttggcaaacatgcggcgcacactcatggagagagtccagagaatgatgggcctctgctgtggctatcagagcaccttcagccagtattcgtacctctatgtggaggaccggaaggaggttctgggtcagtttctgctgtacgggcacatcctcactccggaagaaattgaagaccatgtggaagatggcatcccagagaaccctcccctcctttctcagtttaaagtgcaaatcgactcctatgaaacgctctatgaagaggtgtgcaggctggaacccatcaaggtgtttgacggctggatgaaaattgatattcgaccctttaaggcatctctgctgaatattattaagaggtggagcctcctgttcaaacagcatcttgtggaccacgtcactcacagcttggccaacctggacgcgtttataaagaagagtgagagcggcttactcaagaaagttgaaaaaggagatttccaaggcttggttgagatcatgggacaccttatggctgttaaagaacggcagagtaacactgatgagatgtttgagcccttaaagcagactattgaattgctgaagacctatgaacaagaattgccagaaacagtgtttaagcagctggaggagctgcctgagaaatggaacaacataaaaaaggtggccattactgtgaagcagcaggtggccccactgcaggcaaatgaagtgacactcctccgccagaggtgcacagccttcgatgcagaacagcagcaattctgggagcaattccacaaagaagccccgttcaggtttgatagcatccaccctcatcaaatgctggatgccaggcacatcgagatccagcagatggaatccactatggcctccatttctgagtctgccagcttatttgaagtcaatgtccctgactataagcagctgaggcagtgcaggaaggaggtctgccagctgaaggagctctgggacaccattggaatggtgacctccagcatccatgcctgggagaccacaccctggaggaatatcaacgtggaagccatggagttggagtgcaaacagtttgcccggcatatccgaaacctggacaaggaggtcagggcctgggatgcattcacaggcctggaaagcactgtgtggaacacgctgagctccctgagggcagtagctgagctgcagaatccagccatccgggagcggcactggaggcagctgatgcaggccaccggtgtgagcttcactatggaccaggacaccaccctagcgcacctgctgcagctccagctgcaccactatgaggatgaggtccggggcattgtggacaaagctgcaaaagagatgggtatggagaaaaccttaaaggagctgcagactacctgggctggcatggaattccagtatgagccccacccacggaccaatgtccccctcctgtgctctgatgaggacctcatagaggttctggaggataatcaagttcaacttcagaacctggtgatgtccaagtatgttgctttcttcttggaggaggtgtcgggctggcagaagaagctgtccacagtggacgctgtcatctctatctggtttgaagtgcagcgaacatggactcacctggaaagcatattcactggatctgaagatattcgggcacagctaccccaggattctaaaaggtttgaaggcatcgacattgactttaaagagctagcttatgatgcccagaaaattccaaatgtagtgcaaaccaccaacaagccaggcctgtatgaaaagctggaggatattcagggcagattgtgcctgtgtgagaaggccctggcagagtacctcgacaccaagaggcttgccttcccgcggttttactttctctcctcctccgatctgttagacatcctttccaacggcacagctccacaacaggttcaacgtcacctttccaaactctttgacaacatggccaagatgcgattccagctagatgccagtggggaaccaaccaagacaagcctcggcatgtacagcaaagaagaggagtatgtggctttcagtgagccctgtgactgcagcgggcaggtagaaatatggctgaaccatgtccttggtcacatgaaggccactgtgaggcatgagatgacagaaggtgtaactgcctatgaagaaaagccgagggagcagtggctttttgaccacccagctcaggtggccctgacctgtactcagatctggtggacaacagaagtgggcatggcatttgccaggctggaggaaggctatgagagtgccatgaaggactattataagaagcaagtggcccagctcaaaacccttatcaccatgctgattggccagctctccaagggagaccggcagaagattatgactatatgcaccatcgatgtgcatgcccgggatgtggtagccaagatgattgctcagaaggtagacaatgcccaggctttcctctggctgtctcagctgcgccatcgttgggatgacgaggtcaaacactgctttgccaacatctgtgatgcccagtttttgtattcctatgagtacctgggaaacacacctcgcttggtgatcacacctttgactgacaggtgctacatcaccctcacccagtccctgcacctgaccatgagtggggctcccgcaggacctgcaggcacaggcaagaccgagaccaccaaggacctgggccgcgcactgggcatcctggtctatgtgttcaactgctcggagcagatggattacaagtcttgtggcaacatctacaaaggccttgctcagactggtgcctggggctgctttgatgagtttaatcgaatctccgtggaggtcttgtcagtggtggcagtgcaggtaaaaagcattcaagatgcgattagagataagaagcagtggttcagcttccttggggaggagatcagcctgaatccttctgtcggtatcttcatcaccatgaacccaggctatgctggccgcacagagctgccagagaatctcaagtctctcttcaggccttgtgcaatggtggttccagactttgaattgatctgtgaaatcatgctggtggcagaaggattcattgaagcccagtcattagccagaaagttcatcactctttaccagttgtgcaaagagcttctctccaaacaggatcactacgactggggcctacgggccatcaagtccgtgctggtggtggcaggatccctgaagagaggagaccctgaccggcctgaggaccaggtcctgatgcgctccttgcgggatttcaacatccccaagattgtgactgatgacatgcccatcttcatgggcctgatcggggacctctttcccgccctggatgtcccccggaggagagaccccaacttcgaagctttggttaggaaggcgatagtggatctgaagctccaggctgaggacaactttgtgctcaaggtggtccagctggaggagctcctggctgtgcggcactctgtatttgtggtgggtggcgctggtaccggcaagtcacaggtgctgaggtccttgcacaagacctatcagatcatgaaacggcgccccgtctggactgacctcaatcccaaagcagtcacaaatgatgagctctttggcatcatcaatccagccacaggagaatggaaggatggattgttctcttccatcatgcgggagcttgccaacatcacccatgatgggcccaagtggattttactggatggcgacatagatccaatgtggattgaatccctgaatactgtcatggatgataacaaggtgctgacattggccagcaatgagaggattcctctgaaccccaccatgaagctcctctttgagatcagccacctgcgcacagccactccagcaactgtctctagagcagggatcttgtacatcaacccggcagacttgggatggaaccctccagtgagcagctggattgagaagagggaaatccagacagagagagccaacttaaccattttgttcgacaagtatcttccaacctgcctagacacactcagaaccaggtttaagaagatcattcccatcccagagcagagcatggttcagatggtgtgtcaccttctggaatgtctcctgaccacggaggacatccctgcagactgccctaaggaaatttatgagcattattttgtgtttgctgccatctgggctttcggcggagcaatggtccaagatcagcttgtggactaccgggcagagttcagcaaatggtggctgactgagttcaaaacagtcaagtttccttcccaaggaaccatctttgactattacatcgacccagagaccaagaaattcgagccttggtccaagctcgtcccccagttcgaatttgaccccgagatgcccttgcaggcgtgtttggtgcacacgagtgagaccatccgtgtgtgctacttcatggagcggttgatggcgcggcagcggcctgtcatgctggtgggcacggctggcactggcaagtcggtgctggtgggagctaagctggccagccttgaccccgaggcatacctggtgaaaaacgtgccattcaactactacaccacgtcagcaatgctgcaggctgtcctggagaagcctctggaaaagaaggctggcagaaactatggccctccagggaacaagaaactcatctatttcattgatgacatgaacatgcctgaggtggatgcctacgggacggtgcagccccacaccatcatccggcagcatctggactatggccactggtatgatcggagcaagctgtccctaaaggagatcacaaatgtacagtatgtttcctgtatgaaccccacggcaggcagcttcaccatcaacccccggcttcagcgtcacttcagcgtgtttgtcctctccttcccgggggcagatgccctgtcctctatctacagcatcatcctcactcagcatctgaagctcggaaacttcccggcgtccctgcagaaatccatccccccactgatcgatctggccctcgccttccaccagaaaattgctaccaccttcctacccacaggaatcaaattccactacatcttcaacctcagagattttgccaacattttccagggcattctcttctcctcagtggaatgtgtgaaatccacatgggatcttataaggctctatctgcatgaatcaaatcgagtttatcgggataagatggtagaagaaaaggactttgatctttttgataaaatccagacagaagtgctcaagaaaacttttgatgatattgaagaccctgtggagcagacccaaagcccgaacctgtattgtcactttgcaaatggtattggggagcccaaatacatgcctgtacagtcttgggaacttttgacccagactctggtggaggccttggagaaccacaatgaagtcaacacagtgatggacctagttctctttgaggatgccatgcgccatgtctgccatatcaatcgcatcttggagtccccgcggggaaatgctctgctggttggtgtaggtgggagcggcaagcagagcctgacaaggctggcagctttcatcagctccatggatgtcttccagatcacactgcgcaaaggctaccagatccaggacttcaagatggacctggccagcctgtgtctgaaagctggagtgaagaatctcaacacagtgtttctcatgactgatgcccaagtggctgatgagaggttccttgtgctcatcaatgatcttttggcatctggggagatcccagatctctactctgatgatgaagttgaaaacatcataagcaatgtgaggaatgaagtcaagagccagggtctggttgacaacagagagaactgttggaagttctttatagatcggatccggcgacagctgaaggtgactctctgtttctcccctgtgggaaacaagctaagagtccgcagcaggaagttcccagccattgtgaactgcacagccatccactggttccacgagtggcctcagcaagcattggagtctgtcagcctccgcttcttgcagaacacagagggcattgagcccacagtaaagcagtcgattagcaaattcatggcctttgtccacacaagtgtcaaccaaacatcccagtcttatctgagcaatgaacagcgctacaactatacaactcccaagtcctttctggagttcatcagactctaccagagcttgttgcacaggcacagaaaagagctcaagtgcaagacagagcggttggagaacgggctgctgaagctgcatagcacctctgcccaggtggatgatctgaaagcaaagctggctgcccaggaagtagagctgaagcagaaaaatgaagatgcagacaaactgattcaggtcgtgggtgtggagactgacaaagtgagcagagagaaagccatggcagatgaagaggagcagaaggtggccgtcatcatgctagaggtgaaacagaagcagaaggactgtgaggaggacctggcaaaggctgagccagcactcacagcagcgcaggcagctctcaacaccctgaacaagaccaacctgacagagctgaagtcatttggctctccgcctctggccgtcagcaatgtcagcgctgcggtgatggtactgatggctcccaggggtagggtgcccaaggaccggagctggaaggctgctaaggtcaccatggccaaagtggatggcttcctggactcgctaataaacttcaacaaagagaacattcacgagaactgcctcaaagccatcaggccgtatctgcaagacccggagttcaatcctgagtttgtggccaccaaatcctatgcggctgcaggcctctgctcctgggtcatcaatattgtgagattttatgaggtgttctgtgatgtggaacccaagcgccaggcactgaacaaagccaccgcggacctcacagctgcccaggagaagctggctgccatcaaagccaagatcgctcaccttaatgaaaacctggcaaagctcacagccaggtttgagaaagcaacagcagacaaactcaaatgtcagcaagaagccgaagtgaccgcagtcaccatctcccttgccaaccgcctggttggaggactcgcttctgaaaacgtgaggtgggcagatgccgtgcagaacttcaaacagcaggaaaggacgttatgtggagacattttacttataacggctttcatttcctaccttggcttcttcacaaagaaataccggcagagcctcctggacagaacttggaggccctacctgagccagctgaaaactcccattccagtcaccccagccctggatcccctgaggatgctgatggatgatgctgacgtggctgcctggcagaacgagggcctcccagccgaccgcatgtccgtggagaatgccaccattctcatcaactgtgagcgctggccactcatggttgaccctcagctacaaggcatcaaatggatcaagaataaatatggtgaagatctccgggtcacgcagattggtcagaaaggctaccttcaaatcatagagcaggccctggaagctggagctgtggtgctgattgaaaatctagaggagtccattgatcctgttctgggacccctgcttgggagagaagtcattaaaaaaggacgattcattaaaattggagacaaagaatgtgaatacaatcccaagttccggctcatcctccacaccaagctggctaatcctcactaccagcctgagctgcaggctcaggccaccctgatcaacttcaccgtgaccagggatggcctggaggaccagttgctggccgctgtggtcagcatggagaggccagacttggagcagctgaagtccgatctcacaaagcagcagaatggattcaaaattaccctgaaaacgttggaagacagtcttctctctcgcctctcctccgcctctgggaacttcctgggagaaacagtgctggtggaaaacctagagatcaccaagcagactgctgccgaagttgagaaaaaggtccaggaggccaaggtgactgaagtgaaaatcaacgaggcccgagagcactaccggccagcagctgccagggcctcactgctctacttcatcatgaacgacctcagcaagatccatccaatgtaccagttttctctcaaggccttcagtatcgtcttccagaaggctgtggagagggctgctcctgacgaaagcctcagggagcgggtggccaacctaatagacagcataaccttctctgtgtaccagtacaccatccgcgggctctttgagtgtgataagctgacctaccttgcccagctcacctttcagattctcctcatgaaccgagaagtcaatgcagtggagttggatttcctgcttcgatctccagtgcagacgggcaccgccagccccgtggagttcctctcccatcaggcgtggggagctgtcaaggtactttcatcaatggaagaattctctaatctggatcgggacatagagggatctgctaagagctggaaaaagtttgtggagtccgaatgtcctgagaaagagaagctcccacaggagtggaagaacaagacagccctgcagcgcctctgcatgctgagagccatgcggcccgaccggatgacctatgctttgcgagattttgttgaagagaagttaggaagcaaatacgtggtgggaagagccctagattttgcaacctcatttgaagaatcgggaccagccactcctatgtttttcatcctgtctccaggggtggacccactgaaggatgtagaaagtcaaggaagaaaacttggatacaccttcaacaatcagaactttcacaacgtgtctttggggcaaggacaggaagtggtggctgaggctgcgctggacctcgctgccaagaaaggtcactgggttattttgcaggacactctggagatgtgttctcgggagacggagtttaagagcatcctctttgctctttgttacttccatgcggtggtggcagaaagacgaaaatttgggccccagggatggaatcgctcatacccctttaacactggagacctcactatctctgtgaatgtcctctacaacttcctggaggccaacgcaaaggtcccctatgatgatttgcgctacctgtttggagagatcatgtatggaggccatatcacagatgactgggacagaagactctgcagaacctacctgggggaattcattcgaccagaaatgttagaaggagaactgtctttggccccagggttcccactcccaggcaacatggactacaatggttatcatcagtacatcgatgctgagctgcccccagaatccccctacctctatggcctccacccgaacgcagagattggcttcctgacccaaacctcagaaaagctcttccgcactgtgctggagctgcagcctcgggacagccaggccagagacggagcgggcgccacaagagaagaaaaggtcaaggcacttctggaagaaatattggagcgggtgacagacgagtttaacatcccagaactgatggccaaagtggaggagcgcaccccttacattgtagttgccttccaggagtgtggccggatgaatatcctcaccagagagattcagcgctcactgagggagctggagctcggcttaaagggggagctgactatgaccagccacatggagaacttacagaatgccctgtacttcgatatggtgccagagtcctgggctagacgagcctacccttccacagcaggcctggcagcctggtttccagacctcctcaacagaatcaaggagctagaggcttggacgggtgactttacaatgccctccactgtgtggctgacaggcttcttcaacccccagtcgttcctgactgccatcatgcagtccacggctcgcaagaatgagtggccactggaccagatggccctgcaatgtgacatgacgaagaagaacagagaagagtttaggagtcctcctcgggaaggggcctacatccatggcctcttcatggaaggtgcctgctgggacacacaggctgggatcattacagaggcaaagctgaaggatctgacaccccctatgcctgtgatgttcatcaaggccattcctgcagataagcaggactgccgcagtgtctattcctgtcctgtgtacaagactagtcagcggggacccacctacgtgtggactttcaacctgaagactaaggaaaacccatccaagtgggttctggctggagtagccttgcttctccagatttagcatcctgcagagccaccgagaaaataaaaaagctgggcttggaggctgcctagagggacaggtgggtgaagggtcaccacagacacttagaacggtaagaaaccatgagcactcacaattctgtagaattcctctagggaacttggagaggtgtgcctaaggtgaggctgagctgaaggaatgtgggcccaggtttcttaataaaatgatttactcttc

SEQ ID NO: 287559 - DNA, 4748 bp, Homo sapiens
  misc_feature (4707)..(4707): n is a, c, g, or t
ttagaatattccagcacatttactatggtggagagaggacatccagagttcctgggaaagaaacccaggtcagggagcctggtcccatctgacagcgcagctttgtacctttgtatcaggagctgtcatctattctgctccacagagttgggtcctcaggtcatgcccaacaggccagtgactagtccagtgcccacagtccctccagtcacaactcctgataagtcccgtgcttctccaatgcaggtggatgatctgaaagcaaagctggctgcccaggaagtagagctgaagcagaaaaatgaagatgcagacaaactgattcaggtcgtgggtgtggagactgacaaagtgagcagagagaaagccatggcagatgaagaggagcagaaggtggccgtcatcatgctagaggtgaaacagaagcagaaggactgtgaggaggacctggcaaaggctgagccagcactcacagcagcgcaggcagctctcaacaccctgaacaagaccaacctgacagagctgaagtcatttggctctccgcctctggccgtcagcaatgtcagcgctgcggtgatggtactgatggctcccaggggtagggtgcccaaggaccggagctggaaggctgctaaggtcaccatggccaaagtggatggcttcctggactcgctaataaacttcaacaaagagaacattcacgagaactgcctcaaagccatcaggccgtatctgcaagacccggagttcaatcctgagtttgtggccaccaaatcctatgcggctgcaggcctctgctcctgggtcatcaatattgtgagattttatgaggtgttctgtgatgtggaacccaagcgccaggcactgaacaaagccaccgcggacctcacagctgcccaggagaagctggctgccatcaaagccaagatcgctcaccttaatgaaaacctggcaaagctcacagccaggtttgagaaagcaacagcagacaaactcaaatgtcagcaagaagccgaagtgaccgcagtcaccatctcccttgccaaccgcctggttggaggactcgcttctgaaaacgtgaggtgggcagatgccgtgcagaacttcaaacagcaggaaaggacgttatgtggagacattttacttataacggctttcatttcctaccttggcttcttcacaaagaaataccggcagagcctcctggacagaacttggaggccctacctgagccagctgaaaactcccattccagtcaccccagccctggatcccctgaggatgctgatggatgatgctgacgtggctgcctggcagaacgagggcctcccagccgaccgcatgtccgtggagaatgccaccattctcatcaactgtgagcgctggccactcatggttgaccctcagctacaaggcatcaaatggatcaagaataaatatggtgaagatctccgggtcacgcagattggtcagaaaggctaccttcaaatcatagagcaggccctggaagctggagctgtggtgctgattgaaaatctagaggagtccattgatcctgttctgggacccctgcttgggagagaagtcattaaaaaaggacgattcattaaaattggagacaaagaatgtgaatacaatcccaagttccggctcatcctccacaccaagctggctaatcctcactaccagcctgagctgcaggctcaggccaccctgatcaacttcaccgtgaccagggatggcctggaggaccagttgctggccgctgtggtcagcatggagaggccagacttggagcagctgaagtccgatctcacaaagcagcagaatggattcaaaattaccctgaaaacgttggaagacagtcttctctctcgcctctcctccgcctctgggaacttcctgggagaaacagtgctggtggaaaacctagagatcaccaagcagactgctgccgaagttgagaaaaaggtccaggaggccaaggtgactgaagtgaaaatcaacgaggcccgagagcactaccggccagcagctgccagggcctcactgctctacttcatcatgaacgacctcagcaagatccatccaatgtaccagttttctctcaaggccttcagtatcgtcttccagaaggctgtggagagggctgctcctgacgaaagcctcagggagcgggtggccaacctaatagacagcataaccttctctgtgtaccagtacaccatccgcgggctctttgagtgtgataagctgacctaccttgcccagctcacctttcagattctcctcatgaaccgagaagtcaatgcagtggagttggatttcctgcttcgatctccagtgcagacgggcaccgccagccccgtggagttcctctcccatcaggcgtggggagctgtcaaggtactttcatcaatggaagaattctctaatctggatcgggacatagagggatctgctaagagctggaaaaagtttgtggagtccgaatgtcctgagaaagagaagctcccacaggagtggaagaacaagacagccctgcagcgcctctgcatgctgagagccatgcggcccgaccggatgacctatgctttgcgagattttgttgaagagaagttaggaagcaaatacgtggtgggaagagccctagattttgcaacctcatttgaagaatcgggaccagccactcctatgtttttcatcctgtctccaggggtggacccactgaaggatgtagaaagtcaaggaagaaaacttggatacaccttcaacaatcagaactttcacaacgtgtctttggggcaaggacaggaagtggtggctgaggctgcgctggacctcgctgccaagaaaggtcactgggttattttgcagaacattcacctggtggccaagtggctcagcaccctggagaagaagctggaggagcacagtgagaacagccacccagagttcagggtcttcatgagtgcagagccagcaccctcccctgagggccacatcatcccccagggcatcctggagaactccattaagatcaccaatgagccccccacgggcatgcatgccaacctgcacaaggccctggacaacttcactcaggacactctggagatgtgttctcgggagacggagtttaagagcatcctctttgctctttgttacttccatgcggtggtggcagaaagacgaaaatttgggccccagggatggaatcgctcatacccctttaacactggagacctcactatctctgtgaatgtcctctacaacttcctggaggccaacgcaaaggtcccctatgatgatttgcgctacctgtttggagagatcatgtatggaggccatatcacagatgactgggacagaagactctgcagaacctacctgggggaattcattcgaccagaaatgttagaaggagaactgtctttggccccagggttcccactcccaggcaacatggactacaatggttatcatcagtacatcgatgctgagctgcccccagaatccccctacctctatggcctccacccgaacgcagagattggcttcctgacccaaacctcagaaaagctcttccgcactgtgctggagctgcagcctcgggacagccaggccagagacggagcgggcgccacaagagaagaaaaggtcaaggcacttctggaagaaatattggagcgggtgacagacgagtttaacatcccagaactgatggccaaagtggaggagcgcaccccttacattgtagttgccttccaggagtgtggccggatgaatatcctcaccagagagattcagcgctcactgagggagctggagctcggcttaaagggggagctgactatgaccagccacatggagaacttacagaatgccctgtacttcgatatggtgccagagtcctgggctagacgagcctacccttccacagcaggcctggcagcctggtttccagacctcctcaacagaatcaaggagctagaggcttggacgggtgactttacaatgccctccactgtgtggctgacaggcttcttcaacccccagtcgttcctgactgccatcatgcagtccacggctcgcaagaatgagtggccactggaccagatggccctgcaatgtgacatgacgaagaagaacagagaagagtttaggagtcctcctcgggaaggggcctacatccatggcctcttcatggaaggtgcctgctgggacacacaggctgggatcattacagaggcaaagctgaaggatctgacaccccctatgcctgtgatgttcatcaaggccattcctgcagataagcaggactgccgcagtgtctattcctgtcctgtgtacaagactagtcagcggggacccacctacgtgtggactttcaacctgaagactaaggaaaacccatccaagtgggttctggctggagtagccttgcttctccagatttagcatcctgcagagccaccgagaaaataaaaaagctgggcttggaggctgcctagagggacaggtgggtgaagggtcaccacagacacttagaacggtaagaaaccatgagcactcacaattctgtagaattcctctagggaacttggagaggtgtgcctaaggtgaggctgagctgaaggaatgtgggcccaggtttcttaataaaatgatttactcttcaactgtgtctggcccaggatttgaganctgctgaatcataaatgatcatgtagagaccaagagaaaca

SEQ ID NO: 287560 - DNA, 11035 bp, Homo sapiens
agcagaggagtgagtcctggccgcgtccccgtcgctagggaaaccgatgcagctggaggccgcgcgcgatgcggctcgcggaggagcgggccgcgctcgcggcggagaacgcggatggggaacccggcgccgaccgacgactgcgactcctggggacctacgtggccatgagcctgcggccggctgcgggcgcctgggagcgttgcgcggggagtgctgaggcggagcagctgctccaggccttcctgggccgcgatgctgccgaggggccgcggccgctgctggtggtgcggcccgggcccaggggcctggcaatacgccccgggctggaggtgggacctgagtcgggcctggctggcgctaaggcgctttttttccttcgcaccgggcccgagcctccagggcccgacagcttccgcggcgcagtggtctgcggggacctgcccgcggcacctctggagcacctagccgcgctgttctcggaggttgttctacccgtcctggccaatgagaagaatcgcctaaactggccccacatgatatgtgaggatgtcaggcggcacgcccacagcctccaatgtgacctctcagttatacttgagcaagtgaagggaaaaactttgctgcctcttccagcaggctcagaaaaaatggagtttgcggattccaaaagtgagacagtcttggattctatagataagtcagtcatctatgccattgagtctgcagtgatcaaatggagctaccaagtccaggtggtactcaagagagagtcttcccagccactcttacaaggggagaatcccacccctaaggtggagttggagttctggaagagcaggtatgaagatctgaaatacatctataatcaactgagaacaataacggtgaggggcatggccaagctcctggacaagcttcagagtagctactttccagctttcaaagccatgtacagagatgttgttgcagctctagcagaggcacaggacatccatgtgcacctgataccgctccagcgccacctggaagctctggagaatgcagaatttccggaggtgaagccccagctgcggcccctgctccacgtggtctgtctgatttgggccacatgcaagtcctaccgctccccgggaaggctgactgtgctgctccaggagatttgcaaccttctcatccagcaggcctctaattatctcagcccagaagacctgctgagaagtgaggtagaagaaagtcagagaaaactgcaagtggtctcagacactttgagcttcttcaagcaagagtttcaggacagaagggagaatctccacacttacttcaaagagaaccaggaagtcaaggaatgggatttccagtcttctttggtctttgtgcgattggatggcttcctgggacgactgcacgtggtggagggtcttctgaagacggccctggatttccacaaactgggaaaggtggagttcagcggcgtcagagggaatgctctgagtcagcaggtccagcaaatgcatgaagaatttcaagagatgtacaggcttctctcaggatcctcctccgactgcctgtacctccaaagcacggactttgaaaatgacgtctctgaatttaaccagaaagtagaagatcttgaccgaagattggggactatctttattcaagcttttgatgatgcacctggcttggagcatgcctttaagctgctagacatagcaggaaacctccttgaaagaccgctggtagcgagggatacatctgataaatacctggtcctcatccaaatgttcaacaaagatctggatgcagtgaggatgatctacagtcagcacgtccaggaggaagcagaacttgggttctccccggtgcacaagaacatgcccaccgtggctggcggcctccgctgggcacaggagctgaggcagcgcatccagggtcctttcagcaactttggacgcatcacacacccttgcatggaatctgcagaaggaaagcgaatgcaacaaaaatatgaagatatgctgtcattgctagaaaagtatgagacaagactttatgaggattggtgccggacagtatcagagaagtcacagtacaatctttcccaaccacttctaaaacgtgacccagagacgaaggagatcactatcaactttaacccacagctgatttcagtgctgaaagaaatgagctatcttgaacccagagagatgaaacacatgcctgagacagcagcagccatgttctcctccagggatttctatcggcagcttgtggctaatttagagttgatggcaaattggtacaacaaggttatgaaaactctgctggaggtggaatttccattagtggaggaagagctgcaaaatattgatctccgcctcagagcagcagaggagactttgaactggaaaacagaaggcatttgcgattatgtcactgaaatcaccagtagtattcatgatcttgaacaaagaattcagaaaactaaagacaatgtggaagagatccaaaacatcatgaaaacatgggtgactccaatatttaagacaaaagatggaaaaagggaatcccttctttctctggatgatcggcatgatcgaatggaaaaatattacaatctcatcaaggaatctggccttaagatccacgcccttgttcaggaaaacctgggtctattttcagcagacccaacctccaatatctggaagacttatgttaactctattgacaatttgttgctgaatggattctttcttgccattgagtgctccctcaagtatcttctggaaaatactgagtgtaaggcaggacttaccccaatatttgaagcacaactgagtctagccatcccagagctagttttctatccgtctctggagtctggagtgaaggggggtttctgtgacattgttgagggtctcatcaccagcatttttaggataccatctctggtgccacggctttccccacaaaatggctctcctcactatcaggtcgacctggacggtataccagatttggcaaacatgcggcgcacactcatggagagagtccagagaatgatgggcctctgctgtggctatcagagcaccttcagccagtattcgtacctctatgtggaggaccggaaggaggttctgggtcagtttctgctgtacgggcacatcctcactccggaagaaattgaagaccatgtggaagatggcatcccagagaaccctcccctcctttctcagtttaaagtgcaaatcgactcctatgaaacgctctatgaagaggtgtgcaggctggaacccatcaaggtgtttgacggctggatgaaaattgatattcgaccctttaaggcatctctgctgaatattattaagaggtggagcctcctgttcaaacagcatcttgtggaccacgtcactcacagcttggccaacctggacgcgtttataaagaagagtgagagcggcttactcaagaaagttgaaaaaggagatttccaaggcttggttgagatcatgggacaccttatggctgttaaagaacggcagagtaacactgatgagatgtttgagcccttaaagcagactattgaattgctgaagacctatgaacaagaattgccagaaacagtgtttaagcagctggaggagctgcctgagaaatggaacaacataaaaaaggtggccattactgtgaagcagcaggtggccccactgcaggcaaatgaagtgacactcctccgccagaggtgcacagccttcgatgcagaacagcagcaattctgggagcaattccacaaagaagccccgttcaggtttgatagcatccaccctcatcaaatgctggatgccaggcacatcgagatccagcagatggaatccactatggcctccatttctgagtctgccagcttatttgaagtcaatgtccctgactataagcagctgaggcagtgcaggaaggaggtctgccagctgaaggagctctgggacaccattggaatggtgacctccagcatccatgcctgggagaccacaccctggaggaatatcaacgtggaagccatggagttggagtgcaaacagtttgcccggcatatccgaaacctggacaaggaggtcagggcctgggatgcattcacaggcctggaaagcactgtgtggaacacgctgagctccctgagggcagtagctgagctgcagaatccagccatccgggagcggcactggaggcagctgatgcaggccaccggtgtgagcttcactatggaccaggacaccaccctagcgcacctgctgcagctccagctgcaccactatgaggatgaggtccggggcattgtggacaaagctgcaaaagagatgggtatggagaaaaccttaaaggagctgcagactacctgggctggcatggaattccagtatgagccccacccacggaccaatgtccccctcctgtgctctgatgaggacctcatagaggttctggaggataatcaagttcaacttcagaacctggtgatgtccaagtatgttgctttcttcttggaggaggtgtcgggctggcagaagaagctgtccacagtggacgctgtcatctctatctggtttgaagtgcagcgaacatggactcacctggaaagcatattcactggatctgaagatattcgggcacagctaccccaggattctaaaaggtttgaaggcatcgacattgactttaaagagctagcttatgatgcccagaaaattccaaatgtagtgcaaaccaccaacaagccaggcctgtatgaaaagctggaggatattcagggcagattgtgcctgtgtgagaaggccctggcagagtacctcgacaccaagaggcttgccttcccgcggttttactttctctcctcctccgatctgttagacatcctttccaacggcacagctccacaacaggttcaacgtcacctttccaaactctttgacaacatggccaagatgcgattccagctagatgccagtggggaaccaaccaagacaagcctcggcatgtacagcaaagaagaggagtatgtggctttcagtgagccctgtgactgcagcgggcaggtagaaatatggctgaaccatgtccttggtcacatgaaggccactgtgaggcatgagatgacagaaggtgtaactgcctatgaagaaaagccgagggagcagtggctttttgaccacccagctcaggtggccctgacctgtactcagatctggtggacaacagaagtgggcatggcatttgccaggctggaggaaggctatgagagtgccatgaaggactattataagaagcaagtggcccagctcaaaacccttatcaccatgctgattggccagctctccaagggagaccggcagaagattatgactatatgcaccatcgatgtgcatgcccgggatgtggtagccaagatgattgctcagaaggtagacaatgcccaggctttcctctggctgtctcagctgcgccatcgttgggatgacgaggtcaaacactgctttgccaacatctgtgatgcccagtttttgtattcctatgagtacctgggaaacacacctcgcttggtgatcacacctttgactgacaggtgctacatcaccctcacccagtccctgcacctgaccatgagtggggctcccgcaggacctgcaggcacaggcaagaccgagaccaccaaggacctgggccgcgcactgggcatcctggtctatgtgttcaactgctcggagcagatggattacaagtcttgtggcaacatctacaaaggccttgctcagactggtgcctggggctgctttgatgagtttaatcgaatctccgtggaggtcttgtcagtggtggcagtgcaggtaaaaagcattcaagatgcgattagagataagaagcagtggttcagcttccttggggaggagatcagcctgaatccttctgtcggtatcttcatcaccatgaacccaggctatgctggccgcacagagctgccagagaatctcaagtctctcttcaggccttgtgcaatggtggttccagactttgaattgatctgtgaaatcatgctggtggcagaaggattcattgaagcccagtcattagccagaaagttcatcactctttaccagttgtgcaaagagcttctctccaaacaggatcactacgactggggcctacgggccatcaagtccgtgctggtggtggcaggatccctgaagagaggagaccctgaccggcctgaggaccaggtcctgatgcgctccttgcgggatttcaacatccccaagattgtgactgatgacatgcccatcttcatgggcctgatcggggacctctttcccgccctggatgtcccccggaggagagaccccaacttcgaagctttggttaggaaggcgatagtggatctgaagctccaggctgaggacaactttgtgctcaaggtggtccagctggaggagctcctggctgtgcggcactctgtatttgtggtgggtggcgctggtaccggcaagtcacaggtgctgaggtccttgcacaagacctatcagatcatgaaacggcgccccgtctggactgacctcaatcccaaagcagtcacaaatgatgagctctttggcatcatcaatccagccacaggagaatggaaggatggattgttctcttccatcatgcgggagcttgccaacatcacccatgatgggcccaagtggattttactggatggcgacatagatccaatgtggattgaatccctgaatactgtcatggatgataacaaggtgctgacattggccagcaatgagaggattcctctgaaccccaccatgaagctcctctttgagatcagccacctgcgcacagccactccagcaactgtctctagagcagggatcttgtacatcaacccggcagacttgggatggaaccctccagtgagcagctggattgagaagagggaaatccagacagagagagccaacttaaccattttgttcgacaagtatcttccaacctgcctagacacactcagaaccaggtttaagaagatcattcccatcccagagcagagcatggttcagatggtgtgtcaccttctggaatgtctcctgaccacggaggacatccctgcagactgccctaaggaaatttatgagcattattttgtgtttgctgccatctgggctttcggcggagcaatggtccaagatcagcttgtggactaccgggcagagttcagcaaatggtggctgactgagttcaaaacagtcaagtttccttcccaaggaaccatctttgactattacatcgacccagagaccaagaaattcgagccttggtccaagctcgtcccccagttcgaatttgaccccgagatgcccttgcaggcgtgtttggtgcacacgagtgagaccatccgtgtgtgctacttcatggagcggttgatggcgcggcagcggcctgtcatgctggtgggcacggctggcactggcaagtcggtgctggtgggagctaagctggccagccttgaccccgaggcatacctggtgaaaaacgtgccattcaactactacaccacgtcagcaatgctgcaggctgtcctggagaagcctctggaaaagaaggctggcagaaactatggccctccagggaacaagaaactcatctatttcattgatgacatgaacatgcctgaggtggatgcctacgggacggtgcagccccacaccatcatccggcagcatctggactatggccactggtatgatcggagcaagctgtccctaaaggagatcacaaatgtacagtatgtttcctgtatgaaccccacggcaggcagcttcaccatcaacccccggcttcagcgtcacttcagcgtgtttgtcctctccttcccgggggcagatgccctgtcctctatctacagcatcatcctcactcagcatctgaagctcggaaacttcccggcgtccctgcagaaatccatccccccactgatcgatctggccctcgccttccaccagaaaattgctaccaccttcctacccacaggaatcaaattccactacatcttcaacctcagagattttgccaacattttccagggcattctcttctcctcagtggaatgtgtgaaatccacatgggatcttataaggctctatctgcatgaatcaaatcgagtttatcgggataagatggtagaagaaaaggactttgatctttttgataaaatccagacagaagtgctcaagaaaacttttgatgatattgaagaccctgtggagcagacccaaagcccgaacctgtattgtcactttgcaaatggtattggggagcccaaatacatgcctgtacagtcttgggaacttttgacccagactctggtggaggccttggagaaccacaatgaagtcaacacagtgatggacctagttctctttgaggatgccatgcgccatgtctgccatatcaatcgcatcttggagtccccgcggggaaatgctctgctggttggtgtaggtgggagcggcaagcagagcctgacaaggctggcagctttcatcagctccatggatgtcttccagatcacactgcgcaaaggctaccagatccaggacttcaagatggacctggccagcctgtgtctgaaagctggagtgaagaatctcaacacagtgtttctcatgactgatgcccaagtggctgatgagaggttccttgtgctcatcaatgatcttttggcatctggggagatcccagatctctactctgatgatgaagttgaaaacatcataagcaatgtgaggaatgaagtcaagagccagggtctggttgacaacagagagaactgttggaagttctttatagatcggatccggcgacagctgaaggtgactctctgtttctcccctgtgggaaacaagctaagagtccgcagcaggaagttcccagccattgtgaactgcacagccatccactggttccacgagtggcctcagcaagcattggagtctgtcagcctccgcttcttgcagaacacagagggcattgagcccacagtaaagcagtcgattagcaaattcatggcctttgtccacacaagtgtcaaccaaacatcccagtcttatctgagcaatgaacagcgctacaactatacaactcccaagtcctttctggagttcatcagactctaccagagcttgttgcacaggcacagaaaagagctcaagtgcaagacagagcggttggagaacgggctgctgaagctgcatagcacctctgcccaggtggatgatctgaaagcaaagctggctgcccaggaagtagagctgaagcagaaaaatgaagatgcagacaaactgattcaggtcgtgggtgtggagactgacaaagtgagcagagagaaagccatggcagatgaagaggagcagaaggtggccgtcatcatgctagaggtgaaacagaagcagaaggactgtgaggaggacctggcaaaggctgagccagcactcacagcagcgcaggcagctctcaacaccctgaacaagaccaacctgacagagctgaagtcatttggctctccgcctctggccgtcagcaatgtcagcgctgcggtgatggtactgatggctcccaggggtagggtgcccaaggaccggagctggaaggctgctaaggtcaccatggccaaagtggatggcttcctggactcgctaataaacttcaacaaagagaacattcacgagaactgcctcaaagccatcaggccgtatctgcaagacccggagttcaatcctgagtttgtggccaccaaatcctatgcggctgcaggcctctgctcctgggtcatcaatattgtgagattttatgaggtgttctgtgatgtggaacccaagcgccaggcactgaacaaagccaccgcggacctcacagctgcccaggagaagctggctgccatcaaagccaagatcgctcaccttaatgaaaacctggcaaagctcacagccaggtttgagaaagcaacagcagacaaactcaaatgtcagcaagaagccgaagtgaccgcagtcaccatctcccttgccaaccgcctggttggaggactcgcttctgaaaacgtgaggtgggcagatgccgtgcagaacttcaaacagcaggaaaggacgttatgtggagacattttacttataacggctttcatttcctaccttggcttcttcacaaagaaataccggcagagcctcctggacagaacttggaggccctacctgagccagctgaaaactcccattccagtcaccccagccctggatcccctgaggatgctgatggatgatgctgacgtggctgcctggcagaacgagggcctcccagccgaccgcatgtccgtggagaatgccaccattctcatcaactgtgagcgctggccactcatggttgaccctcagctacaaggcatcaaatggatcaagaataaatatggtgaagatctccgggtcacgcagattggtcagaaaggctaccttcaaatcatagagcaggccctggaagctggagctgtggtgctgattgaaaatctagaggagtccattgatcctgttctgggacccctgcttgggagagaagtcattaaaaaaggacgattcattaaaattggagacaaagaatgtgaatacaatcccaagttccggctcatcctccacaccaagctggctaatcctcactaccagcctgagctgcaggctcaggccaccctgatcaacttcaccgtgaccagggatggcctggaggaccagttgctggccgctgtggtcagcatggagaggccagacttggagcagctgaaggtgaggacagaagggagaaaatgttctgccactagagcctgcagtgtactccactctgggagaggttgcagaggggggctgtttttcctggattgagttaggtgggttctgctagactctggaagactgctgaccccatgtagcaacctgggaataccata

SEQ ID NO: 287561 - DNA, 1238 bp, Homo sapiens
agcagaggagtgagtcctggccgcgtccccgtcgctagggaaaccgatgcagctggaggccgcgcgcgatgcggctcgcggaggagcgggccgcgctcgcggcggagaacgcggatggggaacccggcgccgaccgacgactgcgactcctggggacctacgtggccatgagcctgcggccggctgcgggcgcctgggagcgttgcgcggggagtgctgaggcggagcagctgctccaggccttcctgggccgcgatgctgccgaggggccgcggccgctgctggtggtgcggcccgggcccaggggcctggcaatacgccccgggctggaggtgggacctgagtcgggcctggctggcgctaaggcgctttttttccttcgcaccgggcccgagcctccagggcccgacagcttccgcggcgcagtggtctgcggggacctgcccgcggcacctctggagcacctagccgcgctgttctcggaggttgttctacccgtcctggccaatgagaagaatcgcctaaactggccccacatgatatgtgaggatgtcaggcggcacgcccacagcctccaatgtgacctctcagttatacttgagcaagtgaagggaaaaactttgctgcctcttccagcaggctcagaaaaaatggagtttgcggattccaaaagtgagacagtcttggattctatagataagtcagtcatctatgccattgagtctgcagtgatcaaatggagctaccaagtccaggtggtactcaagagagagtcttcccagccactcttacaaggggagaatcccacccctaaggtggagttggagttctggaagagcaggtatgaagatctgaaatacatctataatcaactgagaacaataacggtgaggggcatggccaagctcctggacaagcttcagagtagctactttccagctttcaaagccatgtacagagatgttgttgcagatgggactgcaatttcctggccatttgagcaccagacaagatctacgcttatcaaaattgccaagccagcaaagtctatgattagaagtaggtaaatttttttaggactccctctccatttcttggagcactgtgcgtcttctccctttttcttgtaaaatctcctctttgctcttcagtaccataggtcaaaatgtgcttttaaaggtctttgtcatttcacatggtctaagcttaattaaagcagtgattttcaaacattaaaa

SEQ ID NO: 287562 - DNA, 565 bp, Homo sapiens
tatggtggagagaggacatccagagttcctgggaaagaaacccaggtcagggagcctggtcccatctgacagcgcagctttgtacctttgtatcaggagctgtcatctattctgctccacagagttgggtcctcaggtcatgcccaacaggccagtgactagtccagtgcccacagtccctccagtcacaactcctgataagtcccgtgcttctccaatgcaggtggatgatctgaaagcaaagctggctgcccaggaagtagagctgaagcagaaaaatgaagatgcagacaaactgattcaggtcgtgggtgtggagactgacaaagtgagcagagagaaagccatggcagatgaagaggagcagaaggtggccgtcatcatgctagaggtgaaacagaagcagaaggactgtgaggaggacctggcaaaggctgagccagcactcacagcagcgcaggcagctctcaacaccctgaacaaggtaggaggactgtctgccatacctgctcatccctcaggggctggtagacgcagagaccaccttggcattcccaagagatgc

SEQ ID NO: 287563 - DNA, 2488 bp, Homo sapiens
agacgtcggcaagctgcgccgccgcttcgggttgcttccggatctggtacttgggcagagctccccggggttcattgtcttcgcttcacaggatctgtttgagtcctgtccaccggatcctacggggggtaccttcgaaaaaaaacgggctatgctgctgttgcgtgtgggtaccctctcctgacgcctccgccgcccgggtcatgtggaccctcgtgggtcggggctgggggtgcgcacgcgctctcgcgccacgagccactggggccgcgcttctggtggccccggggccccggtccgcgccgacccttggggctgctccagagtcctgggctaccgacaggctctacagctccgcagaattcaaggaaaaacctgacatgtctaggtttcctgttgaaaatattagaaatttcagtattgttgcacacgtggatcatggcaaaagtactttagctgacaggctcctagaacttacagggacaattgataaaacaaagaataataagcaggttcttgataaattgcaagtggaacgagaaagaggaatcactgttaaagcacagacagcatctctcttttacaattgtgaaggaaagcagtaccttttaaatctcattgatacaccgggccatgttgattttagttatgaagtatccaggtcactttctgcttgccagggtgttttacttgtggttgatgcaaatgagggaattcaagcccaaactgtagcaaacttctttcttgccttcgaagcacagctatcggtaattccagttataaataagatagatctgaagaatgctgatcctgaaagggttgaaaaccaaattgagaaagtgtttgatattccaagtgatgaatgtattaagatttctgctaaacttggaacaaatgttgagagtgttcttcaggcaattattgaaagaatcccccctcctaaagtgcatcgcaaaaatcctctgagagctttggtatttgactccacctttgaccagtatagaggtgtgatagccaatgtagcattatttgacggagtggtttccaaaggagataaaattgtatctgcacatactcaaaagacatacgaagttaatgaagtaggagtcttgaatcctaatgagcagccaactcataaattatatgcaggacaggtgggctatctgattgctgggatgaaagatgtcactgaagcgcaaataggagatacattatgtttacataagcaaccagtggagcccttgcctgggtttaaatcagcgaaaccaatggtatttgcaggaatgtatcctctagaccaatctgaatataacaatctgaagagtgctatagaaaaactgactttaaatgattccagtgtgaccgttcatcgggatagtagccttgctctgggtgctggctggaggctaggatttcttggacttttgcacatggaagttttcaaccagcgactggagcaagaatataatgcttctgttattttaacaacccctactgttccatataaagctgtactgtcatcatcaaaattgataaaggaacatagagaaaaagaaattacaattatcaatcctgcacaattccccgataaatcaaaagtaacagaatatttggagccagttgttttgggcactattatcacaccagatgaatacactggaaaaataatgatgctttgcgaggctcgaagagcagttcagaagaatatgatatttattgatcaaaatagagttatgcttaaatatctctttcctttgaatgaaattgtggtagatttttatgactctttgaaatccctatcttctggatatgctagttttgattacgaagatgcaggctaccagactgcagaacttgtaaaaatggatattctactgaatggaaatactgtagaggagctagtaactgttgtacacaaagacaaagctcattcaattggcaaagccatatgtgaacggctgaaggattctcttcctaggcaactgtttgagatagcaattcaagctgctattggaagtaaaatcattgcaagagaaactgtgaaagcctataggaaaaacgttttggcaaaatgttatggtggtgatattacccgaaaaatgaagcttttgaagagacaagcagaagggaaaaaaaagctgaggaaaattggcaacgttgaagttccaaaagatgcttttataaaagttctgaaaacacaatcttctaaataattggtgggaaaacaaagaattttcattgcaatttgtaatatgctgacaacagaaagaaaattataaaatttgcttgttactttcagggtattcaggttcaaataacctactagtctttcgttgaaagggagtagttagtgggtaggcaagagcttagattttgaagccatgttgcctgttctcaaatatctgttccaaccactcactagtaaggtgaccgtggccagattaacctttgtttcctcttcagtaaaatcgagattatactactacct

SEQ ID NO: 287564 - DNA, 4211 bp, Homo sapiens
agacgtcggcaagctgcgccgccgcttcgggttgcttccggatctggtacttgggcagagctccccggggttcattgtcttcgcttcacaggatctgtttgagtcctgtccaccggatcctacggggggtaccttcgaaaaaaaacgggctatgctgctgttgcgtgtgggtaccctctcctgacgcctccgccgcccgggtcatgtggaccctcgtgggtcggggctgggggtgcgcacgcgctctcgcgccacgagccactggggccgcgcttctggtggccccggggccccggtccgcgccgacccttggggctgctccagagtcctgggctaccgacaggctctacagctccgcagaattcaaggaaaaacctgacatgtctaggtttcctgttgaaaatattagaaatttcagtattgttgcacacgtggatcatggcaaaagtactttagctgacaggctcctagaacttacagggacaattgataaaacaaagaataataagcaggttcttgataaattgcaagtggaacgagaaagaggaatcactgttaaagcacagacagcatctctcttttacaattgtgaaggaaagcagtaccttttaaatctcattgatacaccgggccatgttgattttagttatgaagtatccaggtcactttctgcttgccagggtgttttacttgtggttgatgcaaatgagggaattcaagcccaaactgtagcaaacttctttcttgccttcgaagcacagctatcggtaattccagttataaataagatagatctgaagaatgctgatcctgaaagggttgaaaaccaaattgagaaagtgtttgatattccaagtgatgaatgtattaagatttctgctaaacttggaacaaatgttgagagtgttcttcaggcaattattgaaagaatcccccctcctaaagtgcatcgcaaaaatcctctgagagctttggtatttgactccacctttgaccagtatagaggtgtgatagccaatgtagcattatttgacggagtggtttccaaaggagataaaattgtatctgcacatactcaaaagacatacgaagttaatgaagtaggagtcttgaatcctaatgagcagccaactcataaattatatgcaggacaggtgggctatctgattgctgggatgaaagatgtcactgaagcgcaaataggagatacattatgtttacataagcaaccagtggagcccttgcctgggtttaaatcagcgaaaccaatggtatttgcaggaatgtatcctctagaccaatctgaatataacaatctgaagagtgctatagaaaaactgactttaaatgattccagtgtgaccgttcatcgggatagtagccttgctctgggtgctggctggaggctaggatttcttggacttttgcacatggaagttttcaaccagcgactggagcaagaatataatgcttctgttattttaacaacccctactgttccatataaagctgtactgtcatcatcaaaattgataaaggaacatagagaaaaagaaattacaattatcaatcctgcacaattccccgataaatcaaaagtaacagaatatttggagccagttgttttgggcactattatcacaccagatgaatacactggaaaaataatgatgctttgcgaggctcgaagagcagttcagaagaatatgatatttattgatcaaaatagagttatgcttaaatatctctttcctttgaatgaaattgtggtagatttttatgactctttgaaatccctatcttctggatatgctagttttgattacgaagatgcaggctaccagactgcagaacttgtaaaaatggatattctactgaatggaaatactgtagaggagctagtaactgttgtacacaaagacaaagctcattcaattggcaaagccatatgtgaacggctgaaggattctcttcctaggcaactgtttgagatagcaattcaagctgctattggaagtaaaatcattgcaagagaaactgtgaaagcctataggaaaaacgttttggcaaaatgttatggtggtgatattacccgaaaaatgaagcttttgaagagacaagcagaagggaaaaaaaagctgaggaaaattggcaacgttgaagttccaaaagatgcttttataaaagttctgaaaacacaatcttctaaataattggtgggaaaacaaagaattttcattgcaatttgtaatatgctgacaacagaaagaaaattataaaatttgcttgttactttcagggtattcaggttcaaataacctactagtctttcgttgaaagggagtagttagtgggtaggcaagagcttagattttgaagccatgttgcctgttctcaaatatctgttccaaccactcactagtaaggtgaccgtggccagattaacctttgtttcctcttcagtaaaatcgagattatactactacctacataagttgttgttgtgaagattaaatgaggtaatacgttaaatattcagaggtgcaagacacatagtaagcactcaattgtaactacagttaagtccttaaatgccatcgaaaggttcttagaaactgactttaagcaaaatgacacgtagcacaatgttcttgaatgatgtcatttccttaagtggtttgtaacatcgatgaggaaaaaaaattggtttatgcgtcatttcattttatttttatttattttttgagacagagtcttgccctgtcgcccaggctggagtgcaatggcacaatctcgactcactgcaacctctgcctcctgggttcaagagattctcctgcctcagcctccattacaggcgtgcaccaccatgctcggctaattttttgtatctttagtagagtcggggtttcaccatgttggccaggctggtcttgaactcctgacctcgtgatccacccaccgtggcctcccaaagtgctgattacaggtgtgagccaccatgcccagccatgtcatttcatttaaagtcacaatttccatgaatctcaacaagtgaggacctgctatattttgttgcatgcagtttttctttacggacactaaaaggccccatacttaagattccatctactttaagtttaaaggattttcagaatcaccttaagtgtcaaatttgttagcaggattaattgatatgaattcacttattaaacagtaaactcaaataacatagacatcaaataacagacatctgctctagttaatgataaaatgtttatagattttatcaggtggttagtttgaaactaaatggtttacatctaaattaagggcaggagctgtctttcagacattcaaaacgcatttgtgtaaaatgacaggtgtttggtattaccaggaactcataatgacattttaataattattgtctaaatttcataatcgaagcgattttagagtagttaacttgagatttcacagccagtaaatggctgtatttctccagagctctcagctcccatgtttattcagccaacgaacaaaccagactgcagactgtattagagcaagacaacatcatttagccattgatttttatcttctaccttgaatgaattgaatgaagaaaatgtcttttagggataaacactatcaaggatgaattttatactaaggttatatgaaagaaaaatctcaaaaccactaagccaaagggaagtcaagctgggaactgattgaggcaaacctgcctcccattttattcctaaataagacagccacaaagataaaatttgctcacaagggaattccttatggacaaagaactcaaagtcttcacatgaaacaaatgcataaatgattgctttctctgtttcatgtttcactaagccagattaaggtataactgactattcctctactctcctctcacatgtaaattgtatattcagtgaaaggctaatcagaaactcaaaaaaatgcaaccctttctctcttacctgcctatgcttgaagcccccgcccctcttcaagttgtcctgcctttcaagaccaatgtacaccttacacatactgattgatgtctcatgtctctctaaaatgtgtaaaaccaagctgtgccccaaccaccttgggcacatgtggtgaggacctcctgaggctgtgtcatgggcacaccttaaccctgggaaaataaactttctaaactg

SEQ ID NO: 287565 - DNA, 4081 bp, Homo sapiens
agacgtcggcaagctgcgccgccgcttcgggttgcttccggatctggtacttgggcagagctccccggggttcattgtcttcgcttcacaggatctgtttgagtcctgtccaccggatcctacggggggtaccttcgaaaaaaaacgggctatgctgctgttgcgtgtgggtaccctctcctgacgcctccgccgcccgggtcatgtggaccctcgtgggtcggggctgggggtgcgcacgcgctctcgcgccacgagccactggggccgcgcttctggtggccccggggccccggtccgcgccgacccttggggctgctccagagtcctgggctaccgacaggctctacagctccgcagaattcaaggaaaaacctgacatgtctaggtttcctgttgaaaatattagaaatttcagtattgttgcacacgtggatcatggcaaaagtactttagctgacaggctcctagaacttacagggacaattgataaaacaaagaataataagcaggttcttgataaattgcaagtggaacgagaaagaggaatcactgttaaagcacagacagcatctctcttttacaattgtgaaggaaagcagtaccttttaaatctcattgatacaccgggccatgttgattttagttatgaagtatccaggtcactttctgcttgccagggtgttttacttgtggttgatgcaaatgagggaattcaagcccaaactgtagcaaacttctttcttgccttcgaagcacagctatcggtaattccagttataaataagatagatctgaagaatgctgatcctgaaagggttgaaaaccaaattgagaaagtgtttgatattccaagtgatgaatgtattaagatttctgctaaacttggaacaaatgttgagagtgttcttcaggcaattattgaaagaatcccccctcctaaagtgcatcgcaaaaatcctctgagagctttggtatttgactccacctttgaccagtatagaggtgtgatagccaatgtagcattatttgacggagtggtttccaaaggagataaaattgtatctgcacatactcaaaagacatacgaagttaatgaagtaggagtcttgaatcctaatgagcagccaactcataaattatatgcaggacaggtgggctatctgattgctgggatgaaagatgtcactgaagcgcaaataggagatacattatgtttacataagcaaccagtggagcccttgcctgggtttaaatcagcgaaaccaatggtatttgcaggaatgtatcctctagaccaatctgaatataacaatctgaagagtgctatagaaaaactgactttaaatgattccagtgtgaccgttcatcgggatagtagccttgctctgggtgctggctggaggctaggatttcttggacttttgcacatggaagttttcaaccagcgactggagcaagaatataatgcttctgttattttaacaacccctactgttccatataaagctgtactgtcatcatcaaaattgataaaggaacatagagaaaaagaaattacaattatcaatcctgcacaattccccgataaatcaaaagtaacagaatatttggagccagttgttttgggcactattatcacaccagatgaatacactggaaaaataatgatgctttgcgaggctcgaagagcagttcagaagaatatgatatttattgatcaaaatagagttatgcttaaatatctctttcctttgaatgaaattgtggtagatttttatgactctttgaaatccctatcttctggatatgctagttttgattacgaagatgcaggctaccagactgcagaacttgtaaaaatggatattctactgaatggaaatactgtagaggagctagtaactgttgtacacaaagacaaagctcattcaattggcaaagccatatgtgaacggctgaaggattctcttcctaggcaactgtttgagatagcaattcaagctgctattggaagtaaaatcattgcaagagaaactgtgaaagcctataggaaaaacgttttggcaaaatgttatggtggtgatattacccgaaaaatgaagcttttgaagagacaagcagaagggaaaaaaaagctgaggaaaattggcaacgttgaagttccaaaagatgcttttataaaagttctgaaaacacaatcttctaaataattggtgggaaaacaaagaattttcattgcaatttgtaatatgctgacaacagaaagaaaattataaaatttgcttgttactttcagggtattcaggttcaaataacctactagtctttcgttgaaagggagtagttagtgggtaggcaagagcttagattttgaagccatgttgcctgttctcaaatatctgttccaaccactcactagtaaggtgaccgtggccagattaacctttgtttcctcttcagtaaaatcgagattatactactacctacataagttgttgttgtgaagattaaatgaggtaatacgttaaatattcagaggtgcaagacacatagtaagcactcaattgtaactacagttaagtccttaaatgccatcgaaaggttcttagaaactgactttaagcaaaatgacacgtagcacaatgttcttgaatgatgtcatttccttaagtggtttgtaacatcgatgaggaaaaaaaattggtttatgcgtcatttcattttatttttatttattttttgagacagagtcttgccctgtcgcccaggctggagtgcaatggcacaatctcgactcactgcaacctctgcctcctgggttcaagagattctcctgcctcagcctccattacaggcgtgtgagccaccatgcccagccatgtcatttcatttaaagtcacaatttccatgaatctcaacaagtgaggacctgctatattttgttgcatgcagtttttctttacggacactaaaaggccccatacttaagattccatctactttaagtttaaaggattttcagaatcaccttaagtgtcaaatttgttagcaggattaattgatatgaattcacttattaaacagtaaactcaaataacatagacatcaaataacagacatctgctctagttaatgataaaatgtttatagattttatcaggtggttagtttgaaactaaatggtttacatctaaattaagggcaggagctgtctttcagacattcaaaacgcatttgtgtaaaatgacaggtgtttggtattaccaggaactcataatgacattttaataattattgtctaaatttcataatcgaagcgattttagagtagttaacttgagatttcacagccagtaaatggctgtatttctccagagctctcagctcccatgtttattcagccaacgaacaaaccagactgcagactgtattagagcaagacaacatcatttagccattgatttttatcttctaccttgaatgaattgaatgaagaaaatgtcttttagggataaacactatcaaggatgaattttatactaaggttatatgaaagaaaaatctcaaaaccactaagccaaagggaagtcaagctgggaactgattgaggcaaacctgcctcccattttattcctaaataagacagccacaaagataaaatttgctcacaagggaattccttatggacaaagaactcaaagtcttcacatgaaacaaatgcataaatgattgctttctctgtttcatgtttcactaagccagattaaggtataactgactattcctctactctcctctcacatgtaaattgtatattcagtgaaaggctaatcagaaactcaaaaaaatgcaaccctttctctcttacctgcctatgcttgaagcccccgcccctcttcaagttgtcctgcctttcaagaccaatgtacaccttacacatactgattgatgtctcatgtctctctaaaatgtgtaaaaccaagctgtgccccaaccaccttgggcacatgtggtgaggacctcctgaggctgtgtcatgggcacaccttaaccctgggaaaataaactttctaaactg

SEQ ID NO: 287566 - DNA, 4377 bp, Homo sapiens
agacgtcggcaagctgcgccgccgcttcgggttgcttccggatctggtacttgggcagagctccccggggttcattgtcttcgcttcacaggatctgtttgagtcctgtccaccggatcctacggggggtaccttcgaaaaaaaacgggctatgctgctgttgcgtgtgggtaccctctcctgacgcctccgccgcccgggtcatgtggaccctcgtgggtcggggctgggggtgcgcacgcgctctcgcgccacgagccactggggccgcgcttctggtggccccggggccccggtccgcgccgacccttggggctgctccagagtcctgggctaccgacaggctctacagctccgcagaattcaaggaaaaacctgacatgtctaggtttcctgttgaaaatattagaaatttcagtattgttgcacacgtggatcatggcaaaagtactttagctgacaggctcctagaacttacagggacaattgataaaacaaagaataataagcaggttcttgataaattgcaagtggaacgagaaagaggaatcactgttaaagcacagacagcatctctcttttacaattgtgaaggaaagcagtaccttttaaatctcattgatacaccgggccatgttgattttagttatgaagtatccaggtcactttctgcttgccagggtgttttacttgtggttgatgcaaatgagggaattcaagcccaaactgtagcaaacttctttcttgccttcgaagcacagctatcggtaattccagttataaataagatagatctgaagaatgctgatcctgaaagggttgaaaaccaaattgagaaagtgtttgatattccaagtgatgaatgtattaagatttctgctaaacttggaacaaatgttgagagtgttcttcaggcaattattgaaagaatcccccctcctaaagtgcatcgcaaaaatcctctgagagctttggtatttgactccacctttgaccagtatagaggtgtgatagccaatgtagcattatttgacggagtggtttccaaaggagataaaattgtatctgcacatactcaaaagacatacgaagttaatgaagtaggagtcttgaatcctaatgagcagccaactcataaattatatgcaggacaggtgggctatctgattgctgggatgaaagatgtcactgaagcgcaaataggagatacattatgtttacataagcaaccagtggagcccttgcctgggtttaaatcagcgaaaccaatggtatttgcaggaatgtatcctctagaccaatctgaatataacaatctgaagagtgctatagaaaaactgactttaaatgattccagtgtgaccgttcatcgggatagtagccttgctctgggtgctggctggaggctaggatttcttggacttttgcacatggaagttttcaaccagcgactggagcaagaatataatgcttctgttattttaacaacccctactgttccatataaagctgtactgtcatcatcaaaattgataaaggaacatagagaaaaagaaattacaattatcaatcctgcacaattccccgataaatcaaaagtaacagaatatttggagccagttgttttgggcactattatcacaccagatgaatacactggaaaaataatgatgctttgcgaggctcgaagagcagttcagaagaatatgatatttattgatcaaaatagagttatgcttaaatatctctttcctttgaatgaaattgtggtagatttttatgactctttgaaatccctatcttctggatatgctagttttgattacgaagatgcaggctaccagactgcagaacttgtaaaaatggatattctactgaatggaaatactgtagaggagctagtaactgttgtacacaaagacaaagctcattcaattggcaaagccatatgtgaacggctgaaggattctcttcctaggcaactgtttgagatagcaattcaagctgctattggaagtaaaatcattgcaagagaaactgtgaaagcctataggaaaaacgttttggcaaaatgttatggtggtgatattacccgaaaaatgaagcttttgaagagacaagcagaagggaaaaaaaagctgaggaaaattggcaacgttgaagttccaaaagatgcttttataaaagttctgaaaacacaatcttctaaataattggtgggaaaacaaagaattttcattgcaatttgtaatatgctgacaacagaaagaaaattataaaatttgcttgttactttcagggtattcaggttcaaataacctactagtctttcgttgaaagggagtagttagtgggtaggcaagagcttagattttgaagccatgttgcctgttctcaaatatctgttccaaccactcactagtaaggtgaccgtggccagattaacctttgtttcctcttcagtaaaatcgagattatactactacctacataagttgttgttgtgaagattaaatgaggtaatacgttaaatattcagaggtgcaagacacatagtaagcactcaattgtaactacagttaagtccttaaatgccatcgaaaggttcttagaaactgactttaagcaaaatgacacgtagcacaatgttcttgaatgatgtcatttccttaagtggtttgtaacatcgatgaggaaaaaaaattggtttatgcgtcatttcattttatttttatttattttttgagacagagtcttgccctgtcgcccaggctggagtgcaatggcacaatctcgactcactgcaacctctgcctcctgggttcaagagattctcctgcctcagcctccattacaggcgtgcaccaccatgctcggctaattttttgtatctttagtagagtcggggtttcaccatgttggccaggctggtcttgaactcctgacctcgtgatccacccaccgtggcctcccaaagtgctgattacaggtgtgagccaccatgcccagccatgtcatttcatttaaagtcacaatttccatgaatctcaacaagtgaggacctgctatattttgttgcatgcagtttttctttacggacactaaaaggccccatacttaagattccatctactttaagtttaaaggattttcagaatcaccttaagtgtcaaatttgttagcaggattaattgatatgaattcacttattaaacagtaaactcaaataacatagacatcaaataacagacatctgctctagttaatgataaaatgtttatagattttatcaggtggttagtttgaaactaaatggtttacatctaaattaagggcaggagctgtctttcagacattcaaaacgcatttgtgtaaaatgacaggtgtttggtattaccaggaactcataatgacattttaataattattgtctaaatttcataatcgaagcgattttagagtagttaacttgagatttcacagccagtaaatggctgtatttctccagagctctcagctcccatgtttattcagccaacgaacaaaccagactgcagactgtattagagcaagacaacatcatttagccattgatttttatcttctaccttgaatgaattgaatgaagaaaatgtcttttagggataaacactatcaaggatgaattttatactaaggttatatgaaagaaaaatctcaaaaccactaagccaaagggaagtcaagctgggaactgattgaggcaaacctgcctcccattttattcctaaataagacagccacaaagataaaatttgctcacaagggaattccttatggacaaagaactcaaagtcttcacatgaaacaaatgcataaatgattgctttctctgtttcatgtttcactaagccagattaaggtataactgactattcctctactctcctctcacatgtaaattgtatattcagtgaaaggctaatcagaaactcaaaaaaatgcaaccctttctctcttacctgcctatgcttgaagcccccgcccctcttcaagttgtcctgcctttcaagaccaatgtacaccttacacatactgattgatgtctcatgtctctctaaaatgtgtaaaaccaagctgtgccccaaccaccttgggcacatgtggtgaggacctcctgaggctgtgtcatgggcacaccttaaccctgggaaaataaactttctaaactggaaaaaaaaaaggggggtttaaattcctcggagggccaagttagtcccgctttttcaagggctatggggcgttatagagcggcggttaaactggtggaaagtttggtttggagactctttgggggtatggccagataccggataattgagtaattggatggtaaat

SEQ ID NO: 287567 - DNA, 4466 bp, Homo sapiens
agacgtcggcaagctgcgccgccgcttcgggttgcttccggatctggtacttgggcagagctccccggggttcattgtcttcgcttcacaggatctgtttgagtcctgtccaccggatcctacggggggtaccttcgaaaaaaaacgggctatgctgctgttgcgtgtgggtaccctctcctgacgcctccgccgcccgggtcatgtggaccctcgtgggtcggggctgggggtgcgcacgcgctctcgcgccacgagccactggggccgcgcttctggtggccccggggccccggtccgcgccgacccttggggctgctccagagtcctgggctaccgacaggctctacagctccgcagaattcaaggaaaaacctgacatgtctaggtttcctgttgaaaatattagaaatttcagtattgttgcacacgtggatcatggcaaaagtactttagctgacaggctcctagaacttacagggacaattgataaaacaaagaataataagcaggttcttgataaattgcaagtggaacgagaaagaggaatcactgttaaagcacagacagcatctctcttttacaattgtgaaggaaagcagtaccttttaaatctcattgatacaccgggccatgttgattttagttatgaagtatccaggtcactttctgcttgccagggtgttttacttgtggttgatgcaaatgagggaattcaagcccaaactgtagcaaacttctttcttgccttcgaagcacagctatcggtaattccagttataaataagatagatctgaagaatgctgatcctgaaagggttgaaaaccaaattgagaaagtgtttgatattccaagtgatgaatgtattaagatttctgctaaacttggaacaaatgttgagagtgttcttcaggcaattattgaaagaatcccccctcctaaagtgcatcgcaaaaatcctctgagagctttggtatttgactccacctttgaccagtatagaggtgtgatagccaatgtagcattatttgacggagtggtttccaaaggagataaaattgtatctgcacatactcaaaagacatacgaagttaatgaagtaggagtcttgaatcctaatgagcagccaactcataaattatatgcaggacaggtgggctatctgattgctgggatgaaagatgtcactgaagcgcaaataggagatacattatgtttacataagcaaccagtggagcccttgcctgggtttaaatcagcgaaaccaatggtatttgcaggaatgtatcctctagaccaatctgaatataacaatctgaagagtgctatagaaaaactgactttaaatgattccagtgtgaccgttcatcgggatagtagccttgctctgggtgctggctggaggctaggatttcttggacttttgcacatggaagttttcaaccagcgactggagcaagaatataatgcttctgttattttaacaacccctactgttccatataaagctgtactgtcatcatcaaaattgataaaggaacatagagaaaaagaaattacaattatcaatcctgcacaattccccgataaatcaaaagtaacagaatatttggagccagttgttttgggcactattatcacaccagatgaatacactggaaaaataatgatgctttgcgaggctcgaagagcagttcagaagaatatgatatttattgatcaaaatagagttatgcttaaatatctctttcctttgaatgaaattgtggtagatttttatgactctttgaaatccctatcttctggatatgctagttttgattacgaagatgcaggctaccagactgcagaacttgtaaaaatggatattctactgaatggaaatactgtagaggagctagtaactgttgtacacaaagacaaagctcattcaattggcaaagccatatgtgaacggctgaaggattctcttcctaggcaactgtttgagatagcaattcaagctgctattggaagtaaaatcattgcaagagaaactgtgaaagcctataggaaaaacgttttggcaaaatgttatggtggtgatattacccgaaaaatgaagcttttgaagagacaagcagaagggaaaaaaaagctgaggaaaattggcaacgttgaagttccaaaagatgcttttataaaagttctgaaaacacaatcttctaaataattggtgggaaaacaaagaattttcattgcaatttgtaatatgctgacaacagaaagaaaattataaaatttgcttgttactttcagggtattcaggttcaaataacctactagtctttcgttgaaagggagtagttagtgggtaggcaagagcttagattttgaagccatgttgcctgttctcaaatatctgttccaaccactcactagtaaggtgaccgtggccagattaacctttgtttcctcttcagtaaaatcgagattatactactacctacataagttgttgttgtgaagattaaatgaggtaatacgttaaatattcagaggtgcaagacacatagtaagcactcaattgtaactacagttaagtccttaaatgccatcgaaaggttcttagaaactgactttaagcaaaatgacacgtagcacaatgttcttgaatgatgtcatttccttaagtggtttgtaacatcgatgaggaaaaaaaattggtttatgcgtcatttcattttatttttatttattttttgagacagagtcttgccctgtcgcccaggctggagtgcaatggcacaatctcgactcactgcaacctctgcctcctgggttcaagagattctcctgcctcagcctccattacaggcgtgcaccaccatgctcggctaattttttgtatctttagtagagtcggggtttcaccatgttggccaggctggtcttgaactcctgacctcgtgatccacccaccgtggcctcccaaagtgctgattacaggtgtgagccaccatgcccagccatgtcatttcatttaaagtcacaatttccatgaatctcaacaagtgaggacctgctatattttgttgcatgcagtttttctttacggacactaaaaggccccatacttaagattccatctactttaagtttaaaggattttcagaatcaccttaagtgtcaaatttgttagcaggattaattgatatgaattcacttattaaacagtaaactcaaataacatagacatcaaataacagacatctgctctagttaatgataaaatgtttatagattttatcaggtggttagtttgaaactaaatggtttacatctaaattaagggcaggagctgtctttcagacattcaaaacgcatttgtgtaaaatgacaggtgtttggtattaccaggaactcataatgacattttaataattattgtctaaatttcataatcgaagcgattttagagtagttaacttgagatttcacagccagtaaatggctgtatttctccagagctctcagctcccatgtttattcagccaacgaacaaaccagactgcagactgtattagagcaagacaacatcatttagccattgatttttatcttctaccttgaatgaattgaatgaagaaaatgtcttttagggataaacactatcaaggatgaattttatactaaggttatatgaaagaaaaatctcaaaaccactaagccaaagggaagtcaagctgggaactgattgaggcaaacctgcctcccattttattcctaaataagacagccacaaagataaaatttgctcacaagggaattccttatggacaaagaactcaaagtcttcacatgaaacaaatgcataaatgattgctttctctgtttcatgtttcactaagccagattaaggtataactgactattcctctactctcctctcacatgtaaattgtatattcagtgaaaggctaatcagaaactcaaaaaaatgcaaccctttctctcttacctgcctatgcttgaagcccccgcccctcttcaagttgtcctgcctttcaagaccaatgtacaccttacacatactgattgatgtctcatgtctctctaaaatgtgtaaaaccaagctgtgccccaaccaccttgggcacatgtggtgaggacctcctgaggctgtgtcatgggcacaccttaaccctgggaaaataaactttctaaactgacttgagagctgtctcagatattttgagcttacagttattgtgaaatcattttaattataaattaagtggagatttacttaaaatcatgtgtagaagtagcctgtgatatagtcctagatacatacattatcatcttatgtatcttccctccctcttccaggttctgataaaaacagatgaaatctgaaagaccatgacagtagtattttgaaaatgacagtatttgaaattaaaaaattgtaaaagtgttctgt

SEQ ID NO: 287568 - DNA, 4009 bp, Homo sapiens
agacgtcggcaagctgcgccgccgcttcgggttgcttccggatctggtacttgggcagagctccccggggttcattgtcttcgcttcacaggatctgtttgagtcctgtccaccggatcctacggggggtaccttcgaaaaaaaacgggctatgctgctgttgcgtgaaaaacctgacatgtctaggtttcctgttgaaaatattagaaatttcagtattgttgcacacgtggatcatggcaaaagtactttagctgacaggctcctagaacttacagggacaattgataaaacaaagaataataagcaggttcttgataaattgcaagtggaacgagaaagaggaatcactgttaaagcacagacagcatctctcttttacaattgtgaaggaaagcagtaccttttaaatctcattgatacaccgggccatgttgattttagttatgaagtatccaggtcactttctgcttgccagggtgttttacttgtggttgatgcaaatgagggaattcaagcccaaactgtagcaaacttctttcttgccttcgaagcacagctatcggtaattccagttataaataagatagatctgaagaatgctgatcctgaaagggttgaaaaccaaattgagaaagtgtttgatattccaagtgatgaatgtattaagatttctgctaaacttggaacaaatgttgagagtgttcttcaggcaattattgaaagaatcccccctcctaaagtgcatcgcaaaaatcctctgagagctttggtatttgactccacctttgaccagtatagaggtgtgatagccaatgtagcattatttgacggagtggtttccaaaggagataaaattgtatctgcacatactcaaaagacatacgaagttaatgaagtaggagtcttgaatcctaatgagcagccaactcataaattatatgcaggacaggtgggctatctgattgctgggatgaaagatgtcactgaagcgcaaataggagatacattatgtttacataagcaaccagtggagcccttgcctgggtttaaatcagcgaaaccaatggtatttgcaggaatgtatcctctagaccaatctgaatataacaatctgaagagtgctatagaaaaactgactttaaatgattccagtgtgaccgttcatcgggatagtagccttgctctgggtgctggctggaggctaggatttcttggacttttgcacatggaagttttcaaccagcgactggagcaagaatataatgcttctgttattttaacaacccctactgttccatataaagctgtactgtcatcatcaaaattgataaaggaacatagagaaaaagaaattacaattatcaatcctgcacaattccccgataaatcaaaagtaacagaatatttggagccagttgttttgggcactattatcacaccagatgaatacactggaaaaataatgatgctttgcgaggctcgaagagcagttcagaagaatatgatatttattgatcaaaatagagttatgcttaaatatctctttcctttgaatgaaattgtggtagatttttatgactctttgaaatccctatcttctggatatgctagttttgattacgaagatgcaggctaccagactgcagaacttgtaaaaatggatattctactgaatggaaatactgtagaggagctagtaactgttgtacacaaagacaaagctcattcaattggcaaagccatatgtgaacggctgaaggattctcttcctaggcaactgtttgagatagcaattcaagctgctattggaagtaaaatcattgcaagagaaactgtgaaagcctataggaaaaacgttttggcaaaatgttatggtggtgatattacccgaaaaatgaagcttttgaagagacaagcagaagggaaaaaaaagctgaggaaaattggcaacgttgaagttccaaaagatgcttttataaaagttctgaaaacacaatcttctaaataattggtgggaaaacaaagaattttcattgcaatttgtaatatgctgacaacagaaagaaaattataaaatttgcttgttactttcagggtattcaggttcaaataacctactagtctttcgttgaaagggagtagttagtgggtaggcaagagcttagattttgaagccatgttgcctgttctcaaatatctgttccaaccactcactagtaaggtgaccgtggccagattaacctttgtttcctcttcagtaaaatcgagattatactactacctacataagttgttgttgtgaagattaaatgaggtaatacgttaaatattcagaggtgcaagacacatagtaagcactcaattgtaactacagttaagtccttaaatgccatcgaaaggttcttagaaactgactttaagcaaaatgacacgtagcacaatgttcttgaatgatgtcatttccttaagtggtttgtaacatcgatgaggaaaaaaaattggtttatgcgtcatttcattttatttttatttattttttgagacagagtcttgccctgtcgcccaggctggagtgcaatggcacaatctcgactcactgcaacctctgcctcctgggttcaagagattctcctgcctcagcctccattacaggcgtgcaccaccatgctcggctaattttttgtatctttagtagagtcggggtttcaccatgttggccaggctggtcttgaactcctgacctcgtgatccacccaccgtggcctcccaaagtgctgattacaggtgtgagccaccatgcccagccatgtcatttcatttaaagtcacaatttccatgaatctcaacaagtgaggacctgctatattttgttgcatgcagtttttctttacggacactaaaaggccccatacttaagattccatctactttaagtttaaaggattttcagaatcaccttaagtgtcaaatttgttagcaggattaattgatatgaattcacttattaaacagtaaactcaaataacatagacatcaaataacagacatctgctctagttaatgataaaatgtttatagattttatcaggtggttagtttgaaactaaatggtttacatctaaattaagggcaggagctgtctttcagacattcaaaacgcatttgtgtaaaatgacaggtgtttggtattaccaggaactcataatgacattttaataattattgtctaaatttcataatcgaagcgattttagagtagttaacttgagatttcacagccagtaaatggctgtatttctccagagctctcagctcccatgtttattcagccaacgaacaaaccagactgcagactgtattagagcaagacaacatcatttagccattgatttttatcttctaccttgaatgaattgaatgaagaaaatgtcttttagggataaacactatcaaggatgaattttatactaaggttatatgaaagaaaaatctcaaaaccactaagccaaagggaagtcaagctgggaactgattgaggcaaacctgcctcccattttattcctaaataagacagccacaaagataaaatttgctcacaagggaattccttatggacaaagaactcaaagtcttcacatgaaacaaatgcataaatgattgctttctctgtttcatgtttcactaagccagattaaggtataactgactattcctctactctcctctcacatgtaaattgtatattcagtgaaaggctaatcagaaactcaaaaaaatgcaaccctttctctcttacctgcctatgcttgaagcccccgcccctcttcaagttgtcctgcctttcaagaccaatgtacaccttacacatactgattgatgtctcatgtctctctaaaatgtgtaaaaccaagctgtgccccaaccaccttgggcacatgtggtgaggacctcctgaggctgtgtcatgggcacaccttaaccctgggaaaataaactttctaaactg

SEQ ID NO: 287569 - DNA, 3952 bp, Homo sapiens
agacgtcggcaagctgcgccgccgcttcgggttgcttccggatctggtacttgggcagagctccccggggttcattgtcttcgcttcacaggatctgtttgagtcctgtccaccggatcctacggggggtaccttcgaaaaaaaacgggctatgctgctgttgcgtgaaaaacctgacatgtctaggtttcctgttgaaaatattagaaatttcagtattgttgcacacgtggatcatggcaaaagtactttagctgacaggctcctagaacttacaggagaaagaggaatcactgttaaagcacagacagcatctctcttttacaattgtgaaggaaagcagtaccttttaaatctcattgatacaccgggccatgttgattttagttatgaagtatccaggtcactttctgcttgccagggtgttttacttgtggttgatgcaaatgagggaattcaagcccaaactgtagcaaacttctttcttgccttcgaagcacagctatcggtaattccagttataaataagatagatctgaagaatgctgatcctgaaagggttgaaaaccaaattgagaaagtgtttgatattccaagtgatgaatgtattaagatttctgctaaacttggaacaaatgttgagagtgttcttcaggcaattattgaaagaatcccccctcctaaagtgcatcgcaaaaatcctctgagagctttggtatttgactccacctttgaccagtatagaggtgtgatagccaatgtagcattatttgacggagtggtttccaaaggagataaaattgtatctgcacatactcaaaagacatacgaagttaatgaagtaggagtcttgaatcctaatgagcagccaactcataaattatatgcaggacaggtgggctatctgattgctgggatgaaagatgtcactgaagcgcaaataggagatacattatgtttacataagcaaccagtggagcccttgcctgggtttaaatcagcgaaaccaatggtatttgcaggaatgtatcctctagaccaatctgaatataacaatctgaagagtgctatagaaaaactgactttaaatgattccagtgtgaccgttcatcgggatagtagccttgctctgggtgctggctggaggctaggatttcttggacttttgcacatggaagttttcaaccagcgactggagcaagaatataatgcttctgttattttaacaacccctactgttccatataaagctgtactgtcatcatcaaaattgataaaggaacatagagaaaaagaaattacaattatcaatcctgcacaattccccgataaatcaaaagtaacagaatatttggagccagttgttttgggcactattatcacaccagatgaatacactggaaaaataatgatgctttgcgaggctcgaagagcagttcagaagaatatgatatttattgatcaaaatagagttatgcttaaatatctctttcctttgaatgaaattgtggtagatttttatgactctttgaaatccctatcttctggatatgctagttttgattacgaagatgcaggctaccagactgcagaacttgtaaaaatggatattctactgaatggaaatactgtagaggagctagtaactgttgtacacaaagacaaagctcattcaattggcaaagccatatgtgaacggctgaaggattctcttcctaggcaactgtttgagatagcaattcaagctgctattggaagtaaaatcattgcaagagaaactgtgaaagcctataggaaaaacgttttggcaaaatgttatggtggtgatattacccgaaaaatgaagcttttgaagagacaagcagaagggaaaaaaaagctgaggaaaattggcaacgttgaagttccaaaagatgcttttataaaagttctgaaaacacaatcttctaaataattggtgggaaaacaaagaattttcattgcaatttgtaatatgctgacaacagaaagaaaattataaaatttgcttgttactttcagggtattcaggttcaaataacctactagtctttcgttgaaagggagtagttagtgggtaggcaagagcttagattttgaagccatgttgcctgttctcaaatatctgttccaaccactcactagtaaggtgaccgtggccagattaacctttgtttcctcttcagtaaaatcgagattatactactacctacataagttgttgttgtgaagattaaatgaggtaatacgttaaatattcagaggtgcaagacacatagtaagcactcaattgtaactacagttaagtccttaaatgccatcgaaaggttcttagaaactgactttaagcaaaatgacacgtagcacaatgttcttgaatgatgtcatttccttaagtggtttgtaacatcgatgaggaaaaaaaattggtttatgcgtcatttcattttatttttatttattttttgagacagagtcttgccctgtcgcccaggctggagtgcaatggcacaatctcgactcactgcaacctctgcctcctgggttcaagagattctcctgcctcagcctccattacaggcgtgcaccaccatgctcggctaattttttgtatctttagtagagtcggggtttcaccatgttggccaggctggtcttgaactcctgacctcgtgatccacccaccgtggcctcccaaagtgctgattacaggtgtgagccaccatgcccagccatgtcatttcatttaaagtcacaatttccatgaatctcaacaagtgaggacctgctatattttgttgcatgcagtttttctttacggacactaaaaggccccatacttaagattccatctactttaagtttaaaggattttcagaatcaccttaagtgtcaaatttgttagcaggattaattgatatgaattcacttattaaacagtaaactcaaataacatagacatcaaataacagacatctgctctagttaatgataaaatgtttatagattttatcaggtggttagtttgaaactaaatggtttacatctaaattaagggcaggagctgtctttcagacattcaaaacgcatttgtgtaaaatgacaggtgtttggtattaccaggaactcataatgacattttaataattattgtctaaatttcataatcgaagcgattttagagtagttaacttgagatttcacagccagtaaatggctgtatttctccagagctctcagctcccatgtttattcagccaacgaacaaaccagactgcagactgtattagagcaagacaacatcatttagccattgatttttatcttctaccttgaatgaattgaatgaagaaaatgtcttttagggataaacactatcaaggatgaattttatactaaggttatatgaaagaaaaatctcaaaaccactaagccaaagggaagtcaagctgggaactgattgaggcaaacctgcctcccattttattcctaaataagacagccacaaagataaaatttgctcacaagggaattccttatggacaaagaactcaaagtcttcacatgaaacaaatgcataaatgattgctttctctgtttcatgtttcactaagccagattaaggtataactgactattcctctactctcctctcacatgtaaattgtatattcagtgaaaggctaatcagaaactcaaaaaaatgcaaccctttctctcttacctgcctatgcttgaagcccccgcccctcttcaagttgtcctgcctttcaagaccaatgtacaccttacacatactgattgatgtctcatgtctctctaaaatgtgtaaaaccaagctgtgccccaaccaccttgggcacatgtggtgaggacctcctgaggctgtgtcatgggcacaccttaaccctgggaaaataaactttctaaactg

SEQ ID NO: 287570 - DNA, 4154 bp, Homo sapiens
agacgtcggcaagctgcgccgccgcttcgggttgcttccggatctggtacttgggcagagctccccggggttcattgtcttcgcttcacaggatctgtttgagtcctgtccaccggatcctacggggggtaccttcgaaaaaaaacgggctatgctgctgttgcgtgtgggtaccctctcctgacgcctccgccgcccgggtcatgtggaccctcgtgggtcggggctgggggtgcgcacgcgctctcgcgccacgagccactggggccgcgcttctggtggccccggggccccggtccgcgccgacccttggggctgctccagagtcctgggctaccgacaggctctacagctccgcagaattcaaggaaaaacctgacatgtctaggtttcctgttgaaaatattagaaatttcagtattgttgcacacgtggatcatggcaaaagtactttagctgacaggctcctagaacttacaggagaaagaggaatcactgttaaagcacagacagcatctctcttttacaattgtgaaggaaagcagtaccttttaaatctcattgatacaccgggccatgttgattttagttatgaagtatccaggtcactttctgcttgccagggtgttttacttgtggttgatgcaaatgagggaattcaagcccaaactgtagcaaacttctttcttgccttcgaagcacagctatcggtaattccagttataaataagatagatctgaagaatgctgatcctgaaagggttgaaaaccaaattgagaaagtgtttgatattccaagtgatgaatgtattaagatttctgctaaacttggaacaaatgttgagagtgttcttcaggcaattattgaaagaatcccccctcctaaagtgcatcgcaaaaatcctctgagagctttggtatttgactccacctttgaccagtatagaggtgtgatagccaatgtagcattatttgacggagtggtttccaaaggagataaaattgtatctgcacatactcaaaagacatacgaagttaatgaagtaggagtcttgaatcctaatgagcagccaactcataaattatatgcaggacaggtgggctatctgattgctgggatgaaagatgtcactgaagcgcaaataggagatacattatgtttacataagcaaccagtggagcccttgcctgggtttaaatcagcgaaaccaatggtatttgcaggaatgtatcctctagaccaatctgaatataacaatctgaagagtgctatagaaaaactgactttaaatgattccagtgtgaccgttcatcgggatagtagccttgctctgggtgctggctggaggctaggatttcttggacttttgcacatggaagttttcaaccagcgactggagcaagaatataatgcttctgttattttaacaacccctactgttccatataaagctgtactgtcatcatcaaaattgataaaggaacatagagaaaaagaaattacaattatcaatcctgcacaattccccgataaatcaaaagtaacagaatatttggagccagttgttttgggcactattatcacaccagatgaatacactggaaaaataatgatgctttgcgaggctcgaagagcagttcagaagaatatgatatttattgatcaaaatagagttatgcttaaatatctctttcctttgaatgaaattgtggtagatttttatgactctttgaaatccctatcttctggatatgctagttttgattacgaagatgcaggctaccagactgcagaacttgtaaaaatggatattctactgaatggaaatactgtagaggagctagtaactgttgtacacaaagacaaagctcattcaattggcaaagccatatgtgaacggctgaaggattctcttcctaggcaactgtttgagatagcaattcaagctgctattggaagtaaaatcattgcaagagaaactgtgaaagcctataggaaaaacgttttggcaaaatgttatggtggtgatattacccgaaaaatgaagcttttgaagagacaagcagaagggaaaaaaaagctgaggaaaattggcaacgttgaagttccaaaagatgcttttataaaagttctgaaaacacaatcttctaaataattggtgggaaaacaaagaattttcattgcaatttgtaatatgctgacaacagaaagaaaattataaaatttgcttgttactttcagggtattcaggttcaaataacctactagtctttcgttgaaagggagtagttagtgggtaggcaagagcttagattttgaagccatgttgcctgttctcaaatatctgttccaaccactcactagtaaggtgaccgtggccagattaacctttgtttcctcttcagtaaaatcgagattatactactacctacataagttgttgttgtgaagattaaatgaggtaatacgttaaatattcagaggtgcaagacacatagtaagcactcaattgtaactacagttaagtccttaaatgccatcgaaaggttcttagaaactgactttaagcaaaatgacacgtagcacaatgttcttgaatgatgtcatttccttaagtggtttgtaacatcgatgaggaaaaaaaattggtttatgcgtcatttcattttatttttatttattttttgagacagagtcttgccctgtcgcccaggctggagtgcaatggcacaatctcgactcactgcaacctctgcctcctgggttcaagagattctcctgcctcagcctccattacaggcgtgcaccaccatgctcggctaattttttgtatctttagtagagtcggggtttcaccatgttggccaggctggtcttgaactcctgacctcgtgatccacccaccgtggcctcccaaagtgctgattacaggtgtgagccaccatgcccagccatgtcatttcatttaaagtcacaatttccatgaatctcaacaagtgaggacctgctatattttgttgcatgcagtttttctttacggacactaaaaggccccatacttaagattccatctactttaagtttaaaggattttcagaatcaccttaagtgtcaaatttgttagcaggattaattgatatgaattcacttattaaacagtaaactcaaataacatagacatcaaataacagacatctgctctagttaatgataaaatgtttatagattttatcaggtggttagtttgaaactaaatggtttacatctaaattaagggcaggagctgtctttcagacattcaaaacgcatttgtgtaaaatgacaggtgtttggtattaccaggaactcataatgacattttaataattattgtctaaatttcataatcgaagcgattttagagtagttaacttgagatttcacagccagtaaatggctgtatttctccagagctctcagctcccatgtttattcagccaacgaacaaaccagactgcagactgtattagagcaagacaacatcatttagccattgatttttatcttctaccttgaatgaattgaatgaagaaaatgtcttttagggataaacactatcaaggatgaattttatactaaggttatatgaaagaaaaatctcaaaaccactaagccaaagggaagtcaagctgggaactgattgaggcaaacctgcctcccattttattcctaaataagacagccacaaagataaaatttgctcacaagggaattccttatggacaaagaactcaaagtcttcacatgaaacaaatgcataaatgattgctttctctgtttcatgtttcactaagccagattaaggtataactgactattcctctactctcctctcacatgtaaattgtatattcagtgaaaggctaatcagaaactcaaaaaaatgcaaccctttctctcttacctgcctatgcttgaagcccccgcccctcttcaagttgtcctgcctttcaagaccaatgtacaccttacacatactgattgatgtctcatgtctctctaaaatgtgtaaaaccaagctgtgccccaaccaccttgggcacatgtggtgaggacctcctgaggctgtgtcatgggcacaccttaaccctgggaaaataaactttctaaactg

SEQ ID NO: 287571 - DNA, 3610 bp, Homo sapiens
gcttcttgttgttgctgctcattgtgtatccaagtcattgtgcatgctctgcaaggatgctgtgcccctgtgtagagtctggttcggatagaggcgagattcaccgacgccatacattgataagtaatatatacgtctactgtcgtttcagacgcggagcatatcggtaattccagttataaataagatagatctgaagaatgctgatcctgaaagggttgaaaaccaaattgagaaagtgtttgatattccaagtgatgaatgtattaagatttctgctaaacttggaacaaatgttgagagtgttcttcaggcaattattgaaagaatcccccctcctaaagtgcatcgcaaaaatcctctgagagctttggtatttgactccacctttgaccagtatagaggtgtgatagccaatgtagcattatttgacggagtggtttccaaaggagataaaattgtatctgcacatactcaaaagacatacgaagttaatgaagtaggagtcttgaatcctaatgagcagccaactcataaattatatgcaggacaggtgggctatctgattgctgggatgaaagatgtcactgaagcgcaaataggagatacattatgtttacataagcaaccagtggagcccttgcctgggtttaaatcagcgaaaccaatggtatttgcaggaatgtatcctctagaccaatctgaatataacaatctgaagagtgctatagaaaaactgactttaaatgattccagtgtgaccgttcatcgggatagtagccttgctctgggtgctggctggaggctaggatttcttggacttttgcacatggaagttttcaaccagcgactggagcaagaatataatgcttctgttattttaacaacccctactgttccatataaagctgtactgtcatcatcaaaattgataaaggaacatagagaaaaagaaattacaattatcaatcctgcacaattccccgataaatcaaaagtaacagaatatttggagccagttgttttgggcactattatcacaccagatgaatacactggaaaaataatgatgctttgcgaggctcgaagagcagttcagaagaatatgatatttattgatcaaaatagagttatgcttaaatatctctttcctttgaatgaaattgtggtagatttttatgactctttgaaatccctatcttctggatatgctagttttgattacgaagatgcaggctaccagactgcagaacttgtaaaaatggatattctactgaatggaaatactgtagaggagctagtaactgttgtacacaaagacaaagctcattcaattggcaaagccatatgtgaacggctgaaggattctcttcctaggcaactgtttgagatagcaattcaagctgctattggaagtaaaatcattgcaagagaaactgtgaaagcctataggaaaaacgttttggcaaaatgttatggtggtgatattacccgaaaaatgaagcttttgaagagacaagcagaagggaaaaaaaagctgaggaaaattggcaacgttgaagttccaaaagatgcttttataaaagttctgaaaacacaatcttctaaataattggtgggaaaacaaagaattttcattgcaatttgtaatatgctgacaacagaaagaaaattataaaatttgcttgttactttcagggtattcaggttcaaataacctactagtctttcgttgaaagggagtagttagtgggtaggcaagagcttagattttgaagccatgttgcctgttctcaaatatctgttccaaccactcactagtaaggtgaccgtggccagattaacctttgtttcctcttcagtaaaatcgagattatactactacctacataagttgttgttgtgaagattaaatgaggtaatacgttaaatattcagaggtgcaagacacatagtaagcactcaattgtaactacagttaagtccttaaatgccatcgaaaggttcttagaaactgactttaagcaaaatgacacgtagcacaatgttcttgaatgatgtcatttccttaagtggtttgtaacatcgatgaggaaaaaaaattggtttatgcgtcatttcattttatttttatttattttttgagacagagtcttgccctgtcgcccaggctggagtgcaatggcacaatctcgactcactgcaacctctgcctcctgggttcaagagattctcctgcctcagcctccattacaggcgtgcaccaccatgctcggctaattttttgtatctttagtagagtcggggtttcaccatgttggccaggctggtcttgaactcctgacctcgtgatccacccaccgtggcctcccaaagtgctgattacaggtgtgagccaccatgcccagccatgtcatttcatttaaagtcacaatttccatgaatctcaacaagtgaggacctgctatattttgttgcatgcagtttttctttacggacactaaaaggccccatacttaagattccatctactttaagtttaaaggattttcagaatcaccttaagtgtcaaatttgttagcaggattaattgatatgaattcacttattaaacagtaaactcaaataacatagacatcaaataacagacatctgctctagttaatgataaaatgtttatagattttatcaggtggttagtttgaaactaaatggtttacatctaaattaagggcaggagctgtctttcagacattcaaaacgcatttgtgtaaaatgacaggtgtttggtattaccaggaactcataatgacattttaataattattgtctaaatttcataatcgaagcgattttagagtagttaacttgagatttcacagccagtaaatggctgtatttctccagagctctcagctcccatgtttattcagccaacgaacaaaccagactgcagactgtattagagcaagacaacatcatttagccattgatttttatcttctaccttgaatgaattgaatgaagaaaatgtcttttagggataaacactatcaaggatgaattttatactaaggttatatgaaagaaaaatctcaaaaccactaagccaaagggaagtcaagctgggaactgattgaggcaaacctgcctcccattttattcctaaataagacagccacaaagataaaatttgctcacaagggaattccttatggacaaagaactcaaagtcttcacatgaaacaaatgcataaatgattgctttctctgtttcatgtttcactaagccagattaaggtataactgactattcctctactctcctctcacatgtaaattgtatattcagtgaaaggctaatcagaaactcaaaaaaatgcaaccctttctctcttacctgcctatgcttgaagcccccgcccctcttcaagttgtcctgcctttcaagaccaatgtacaccttacacatactgattgatgtctcatgtctctctaaaatgtgtaaaaccaagctgtgccccaaccaccttgggcacatgtggtgaggacctcctgaggctgtgtcatgggcacaccttaaccctgggaaaataaactttctaaactg

SEQ ID NO: 287572 - DNA, 3951 bp, Homo sapiens
agacgtcggcaagctgcgccgccgcttcgggttgcttccggatctggtacttgggcagagctccccggggttcattgtcttcgcttcacaggatctgtttgagtcctgtccaccggatcctacggggggtaccttcgaaaaaaaacgggctatgctgctgttgcgtgtgggtaccctctcctgacgcctccgccgcccgggtcatgtggaccctcgtgggtcggggctgggggtgcgcacgcgctctcgcgccacgagccactggggccgcgcttctggtggccccggggccccggtccgcgccgacccttggggctgctccagagtcctgggctaccgacaggctctacagctccgcagaattcaaggaaaaacctgacatgtctaggtttcctgttgaaaatattagaaatttcagtattgttgcacacgtggatcatggcaaaagtactttagctgacaggctcctagaacttacagggacaattgataaaacaaagaataataagcaggttcttgataaattgcaagtggaacgagaaagaggaatcactgttaaagcacagacagcatctctcttttacaattgtgaaggaaagcagtaccttttaaatctcattgatacaccgggccatgttgattttagttatgaagtatccaggtcactttctgcttgccagggtgttttacttgtggttgatgcaaatgagggaattcaagcccaaactgtagcaaacttctttcttgccttcgaagcacagctatcggtaattccagttataaataagatagatctgaagaatgctgatcctgaaagggttgaaaaccaaattgagaaagtgtttgatattccaagtgatgaatgtattaagatttctgctaaacttggaacaaatgttgagagtgttcttcaggcaattattgaaagaatcccccctcctaaagtgcatcgcaaaaatcctctgagagctttggtatttgactccacctttgaccagtatagaggtgtgatagccaatgtagcattatttgacggagtggtttccaaaggagataaaattgtatctgcacatactcaaaagacatacgaagttaatgaagtaggagtcttgaatcctaatgagcagccaactcataaattgaatgtatcctctagaccaatctgaatataacaatctgaagagtgctatagaaaaactgactttaaatgattccagtgtgaccgttcatcgggatagtagccttgctctgggtgctggctggaggctaggatttcttggacttttgcacatggaagttttcaaccagcgactggagcaagaatataatgcttctgttattttaacaacccctactgttccatataaagctgtactgtcatcatcaaaattgataaaggaacatagagaaaaagaaattacaattatcaatcctgcacaattccccgataaatcaaaagtaacagaatatttggagccagttgttttgggcactattatcacaccagatgaatacactggaaaaataatgatgctttgcgaggctcgaagagcagttcagaagaatatgatatttattgatcaaaatagagttatgcttaaatatctctttcctttgaatgaaattgtggtagatttttatgactctttgaaatccctatcttctggatatgctagttttgattacgaagatgcaggctaccagactgcagaacttgtaaaaatggatattctactgaatggaaatactgtagaggagctagtaactgttgtacacaatgtgaaagcctataggaaaaacgttttggcaaaatgttatggtggtgatattacccgaaaaatgaagcttttgaagagacaagcagaagggaaaaaaaagctgaggaaaattggcaacgttgaagttccaaaagatgcttttataaaagttctgaaaacacaatcttctaaataattggtgggaaaacaaagaattttcattgcaatttgtaatatgctgacaacagaaagaaaattataaaatttgcttgttactttcagggtattcaggttcaaataacctactagtctttcgttgaaagggagtagttagtgggtaggcaagagcttagattttgaagccatgttgcctgttctcaaatatctgttccaaccactcactagtaaggtgaccgtggccagattaacctttgtttcctcttcagtaaaatcgagattatactactacctacataagttgttgttgtgaagattaaatgaggtaatacgttaaatattcagaggtgcaagacacatagtaagcactcaattgtaactacagttaagtccttaaatgccatcgaaaggttcttagaaactgactttaagcaaaatgacacgtagcacaatgttcttgaatgatgtcatttccttaagtggtttgtaacatcgatgaggaaaaaaaattggtttatgcgtcatttcattttatttttatttattttttgagacagagtcttgccctgtcgcccaggctggagtgcaatggcacaatctcgactcactgcaacctctgcctcctgggttcaagagattctcctgcctcagcctccattacaggcgtgcaccaccatgctcggctaattttttgtatctttagtagagtcggggtttcaccatgttggccaggctggtcttgaactcctgacctcgtgatccacccaccgtggcctcccaaagtgctgattacaggtgtgagccaccatgcccagccatgtcatttcatttaaagtcacaatttccatgaatctcaacaagtgaggacctgctatattttgttgcatgcagtttttctttacggacactaaaaggccccatacttaagattccatctactttaagtttaaaggattttcagaatcaccttaagtgtcaaatttgttagcaggattaattgatatgaattcacttattaaacagtaaactcaaataacatagacatcaaataacagacatctgctctagttaatgataaaatgtttatagattttatcaggtggttagtttgaaactaaatggtttacatctaaattaagggcaggagctgtctttcagacattcaaaacgcatttgtgtaaaatgacaggtgtttggtattaccaggaactcataatgacattttaataattattgtctaaatttcataatcgaagcgattttagagtagttaacttgagatttcacagccagtaaatggctgtatttctccagagctctcagctcccatgtttattcagccaacgaacaaaccagactgcagactgtattagagcaagacaacatcatttagccattgatttttatcttctaccttgaatgaattgaatgaagaaaatgtcttttagggataaacactatcaaggatgaattttatactaaggttatatgaaagaaaaatctcaaaaccactaagccaaagggaagtcaagctgggaactgattgaggcaaacctgcctcccattttattcctaaataagacagccacaaagataaaatttgctcacaagggaattccttatggacaaagaactcaaagtcttcacatgaaacaaatgcataaatgattgctttctctgtttcatgtttcactaagccagattaaggtataactgactattcctctactctcctctcacatgtaaattgtatattcagtgaaaggctaatcagaaactcaaaaaaatgcaaccctttctctcttacctgcctatgcttgaagcccccgcccctcttcaagttgtcctgcctttcaagaccaatgtacaccttacacatactgattgatgtctcatgtctctctaaaatgtgtaaaaccaagctgtgccccaaccaccttgggcacatgtggtgaggacctcctgaggctgtgtcatgggcacaccttaaccctgggaaaataaactttctaaactg

SEQ ID NO: 287573 - DNA, 2748 bp, Homo sapiens
ccaaataggaaatccaaaggtctcatttattaatggcattttatgagtgtcatagcatttatttaaacatagagttgtcattggtaatagaaagttaaacagaaacccaactcatgaatctgaaaatgatccattaataatatatagtattgtccgaagcctcccagctgctgggaacattgggaaggcatgatatttgtcttcaataaaccattttctttgtcaggttcaccagcttattttcctttcccctataaacatattccccttgcttttgcccttgatttaataaacataaaaagataacatttagatccattcacaagaaactgtatatgtaatattttgatggaaacatatctctttggggagtgtaatgcggtagaaagtagacatttagtaaagagtaaagagtaataaaggtaatctctcaggaagtgtaatatttatcacttggacttttttccttttagttttgattacgaagatgcaggctaccagactgcagaacttgtaaaaatggatattctactgaatggaaatactgtagaggagctagtaactgttgtacacaatgtgaaagcctataggaaaaacgttttggcaaaatgttatggtggtgatattacccgaaaaatgaagcttttgaagagacaagcagaagggaaaaaaaagctgaggaaaattggcaacgttgaagttccaaaagatgcttttataaaagttctgaaaacacaatcttctaaataattggtgggaaaacaaagaattttcattgcaatttgtaatatgctgacaacagaaagaaaattataaaatttgcttgttactttcagggtattcaggttcaaataacctactagtctttcgttgaaagggagtagttagtgggtaggcaagagcttagattttgaagccatgttgcctgttctcaaatatctgttccaaccactcactagtaaggtgaccgtggccagattaacctttgtttcctcttcagtaaaatcgagattatactactacctacataagttgttgttgtgaagattaaatgaggtaatacgttaaatattcagaggtgcaagacacatagtaagcactcaattgtaactacagttaagtccttaaatgccatcgaaaggttcttagaaactgactttaagcaaaatgacacgtagcacaatgttcttgaatgatgtcatttccttaagtggtttgtaacatcgatgaggaaaaaaaattggtttatgcgtcatttcattttatttttatttattttttgagacagagtcttgccctgtcgcccaggctggagtgcaatggcacaatctcgactcactgcaacctctgcctcctgggttcaagagattctcctgcctcagcctccattacaggcgtgcaccaccatgctcggctaattttttgtatctttagtagagtcggggtttcaccatgttggccaggctggtcttgaactcctgacctcgtgatccacccaccgtggcctcccaaagtgctgattacaggtgtgagccaccatgcccagccatgtcatttcatttaaagtcacaatttccatgaatctcaacaagtgaggacctgctatattttgttgcatgcagtttttctttacggacactaaaaggccccatacttaagattccatctactttaagtttaaaggattttcagaatcaccttaagtgtcaaatttgttagcaggattaattgatatgaattcacttattaaacagtaaactcaaataacatagacatcaaataacagacatctgctctagttaatgataaaatgtttatagattttatcaggtggttagtttgaaactaaatggtttacatctaaattaagggcaggagctgtctttcagacattcaaaacgcatttgtgtaaaatgacaggtgtttggtattaccaggaactcataatgacattttaataattattgtctaaatttcataatcgaagcgattttagagtagttaacttgagatttcacagccagtaaatggctgtatttctccagagctctcagctcccatgtttattcagccaacgaacaaaccagactgcagactgtattagagcaagacaacatcatttagccattgatttttatcttctaccttgaatgaattgaatgaagaaaatgtcttttagggataaacactatcaaggatgaattttatactaaggttatatgaaagaaaaatctcaaaaccactaagccaaagggaagtcaagctgggaactgattgaggcaaacctgcctcccattttattcctaaataagacagccacaaagataaaatttgctcacaagggaattccttatggacaaagaactcaaagtcttcacatgaaacaaatgcataaatgattgctttctctgtttcatgtttcactaagccagattaaggtataactgactattcctctactctcctctcacatgtaaattgtatattcagtgaaaggctaatcagaaactcaaaaaaatgcaaccctttctctcttacctgcctatgcttgaagcccccgcccctcttcaagttgtcctgcctttcaagaccaatgtacaccttacacatactgattgatgtctcatgtctctctaaaatgtgtaaaaccaagctgtgccccaaccaccttgggcacatgtggtgaggacctcctgaggctgtgtcatgggcacaccttaaccctgggaaaataaactttctaaactg

SEQ ID NO: 287574 - DNA, 3536 bp, Homo sapiens
agacgtcggcaagctgcgccgccgcttcgggttgcttccggatctggtacttgggcagagctccccggggttcattgtcttcgcttcacaggatctgtttgagtcctgtccaccggatcctacggggggtaccttcgaaaaaaaacgggctatgctgctgttgcgtgtgggtaccctctcctgacgcctccgccgcccgggtcatgtggaccctcgtgggtcggggctgggggtgcgcacgcgctctcgcgccacgagccactggggccgcgcttctggtggccccggggccccggtccgcgccgacccttggggctgctccagagtcctgggctaccgacaggctctacagctccgcagaattcaaggaaaaacctgacatgtctaggtttcctgttgaaaatattagaaatttcagtattgttgcacacgtggatcatggcaaaagtactttagctgacaggctcctagaacttacagggacaattgataaaacaaagaataataagcaggttcttgataaattgcaagtggaacgagaaagaggaatcactgttaaagcacagacagcatctctcttttacaattgtgaaggaaagcagtaccttttaaatctcattgatacaccgggccatgttgattttagttatgaagtatccaggtcactttctgcttgccagggtgttttacttgtggttgatgcaaatgagggaattcaagcccaaactgtagcaaacttctttcttgccttcgaagcacagctatcggtaattccagttataaataagatagatctgaagaatgctgatcctgaaagggttgaaaaccaaattgagaaagtgtttgatattccaagtgatgaatgtattaagatttctgctaaacttggaacaaatgttgagagtgttcttcaggcaattattgaaagaatcccccctcctaaagtgcatcgcaaaaatcctctgagagctttggtatttgactccacctttgaccagtatagaggtgtgatagccaatgtagcattatttgacggagtggtttccaaaggagataaaattgtatctgcacatactcaaaagacatacgaagttaatgaagtaggagtcttgaatcctaatgagcagccaactcataaattgaatgtatcctctagaccaatctgaatataacaatctgaagagtgctatagaaaaactgactttaaatgattccagtgtgaccgttcatcgggatagtagccttgctctgggtgctggctggaggctaggatttcttggacttttgcacatggaagttttcaaccagcgactggagcaagaatataatgcttctgttattttaacaacccctactgttccatataaagctgtactgtcatcatcaaaattgataaaggaacatagagaaaaagaaattacaattatcaatcctgcacaattccccgataaatcaaaagtaacagaatatttggagccagttgttttgggcactattatcacaccagatgaatacactggaaaaataatgatgctttgcgaggctcgaagagcagttcagaagaatatgatatttattgatcaaaatagagttatgcttaaatatctctttcctttgaatgaaattgtggtagatttttatgactctttgaaatccctatcttctggatatgctagttttgattacgaagatgcaggctaccagactgcagaacttgtaaaaatggatattctactgaatggaaatactgtagaggagctagtaactgttgtacacaaagacaaagctcattcaattggcaaagccatatgtgaacggctgaaggattctcttcctaggcaactgtttgagatagcaattcaagctgctattggaagtaaaatcattgcaagagaaactgtgaaagcctataggaaaaacgttttggcaaaatgttatggtggtgatattacccgaaaaatgaagcttttgaagagacaagcagaagggaaaaaaaagctgaggaaaattggcaacgttgaagttccaaaagatgcttttataaaagttctgaaaacacaatcttctaaataattgagtcttgccctgtcgcccaggctggagtgcaatggcacaatctcgactcactgcaacctctgcctcctgggttcaagagattctcctgcctcagcctccattacaggcgtgcaccaccatgctcggctaattttttgtatctttagtagagtcggggtttcaccatgttggccaggctggtcttgaactcctgacctcgtgatccacccaccgtggcctcccaaagtgctgattacaggtgtgagccaccatgcccagccatgtcatttcatttaaagtcacaatttccatgaatctcaacaagtgaggacctgctatattttgttgcatgcagtttttctttacggacactaaaaggccccatacttaagattccatctactttaagtttaaaggattttcagaatcaccttaagtgtcaaatttgttagcaggattaattgatatgaattcacttattaaacagtaaactcaaataacatagacatcaaataacagacatctgctctagttaatgataaaatgtttatagattttatcaggtggttagtttgaaactaaatggtttacatctaaattaagggcaggagctgtctttcagacattcaaaacgcatttgtgtaaaatgacaggtgtttggtattaccaggaactcataatgacattttaataattattgtctaaatttcataatcgaagcgattttagagtagttaacttgagatttcacagccagtaaatggctgtatttctccagagctctcagctcccatgtttattcagccaacgaacaaaccagactgcagactgtattagagcaagacaacatcatttagccattgatttttatcttctaccttgaatgaattgaatgaagaaaatgtcttttagggataaacactatcaaggatgaattttatactaaggttatatgaaagaaaaatctcaaaaccactaagccaaagggaagtcaagctgggaactgattgaggcaaacctgcctcccattttattcctaaataagacagccacaaagataaaatttgctcacaagggaattccttatggacaaagaactcaaagtcttcacatgaaacaaatgcataaatgattgctttctctgtttcatgtttcactaagccagattaaggtataactgactattcctctactctcctctcacatgtaaattgtatattcagtgaaaggctaatcagaaactcaaaaaaatgcaaccctttctctcttacctgcctatgcttgaagcccccgcccctcttcaagttgtcctgcctttcaagaccaatgtacaccttacacatactgattgatgtctcatgtctctctaaaatgtgtaaaaccaagctgtgccccaaccaccttgggcacatgtggtgaggacctcctgaggctgtgtcatgggcacaccttaaccctgggaaaataaactttctaaactg

SEQ ID NO: 287575 - DNA, 2868 bp, Homo sapiens
ccaaataggaaatccaaaggtctcatttattaatggcattttatgagtgtcatagcatttatttaaacatagagttgtcattggtaatagaaagttaaacagaaacccaactcatgaatctgaaaatgatccattaataatatatagtattgtccgaagcctcccagctgctgggaacattgggaaggcatgatatttgtcttcaataaaccattttctttgtcaggttcaccagcttattttcctttcccctataaacatattccccttgcttttgcccttgatttaataaacataaaaagataacatttagatccattcacaagaaactgtatatgtaatattttgatggaaacatatctctttggggagtgtaatgcggtagaaagtagacatttagtaaagagtaaagagtaataaaggtaatctctcaggaagtgtaatatttatcacttggacttttttccttttagttttgattacgaagatgcaggctaccagactgcagaacttgtaaaaatggatattctactgaatggaaatactgtagaggagctagtaactgttgtacacaaagacaaagctcattcaattggcaaagccatatgtgaacggctgaaggattctcttcctaggcaactgtttgagatagcaattcaagctgctattggaagtaaaatcattgcaagagaaactgtgaaagcctataggaaaaacgttttggcaaaatgttatggtggtgatattacccgaaaaatgaagcttttgaagagacaagcagaagggaaaaaaaagctgaggaaaattggcaacgttgaagttccaaaagatgcttttataaaagttctgaaaacacaatcttctaaataattggtgggaaaacaaagaattttcattgcaatttgtaatatgctgacaacagaaagaaaattataaaatttgcttgttactttcagggtattcaggttcaaataacctactagtctttcgttgaaagggagtagttagtgggtaggcaagagcttagattttgaagccatgttgcctgttctcaaatatctgttccaaccactcactagtaaggtgaccgtggccagattaacctttgtttcctcttcagtaaaatcgagattatactactacctacataagttgttgttgtgaagattaaatgaggtaatacgttaaatattcagaggtgcaagacacatagtaagcactcaattgtaactacagttaagtccttaaatgccatcgaaaggttcttagaaactgactttaagcaaaatgacacgtagcacaatgttcttgaatgatgtcatttccttaagtggtttgtaacatcgatgaggaaaaaaaattggtttatgcgtcatttcattttatttttatttattttttgagacagagtcttgccctgtcgcccaggctggagtgcaatggcacaatctcgactcactgcaacctctgcctcctgggttcaagagattctcctgcctcagcctccattacaggcgtgcaccaccatgctcggctaattttttgtatctttagtagagtcggggtttcaccatgttggccaggctggtcttgaactcctgacctcgtgatccacccaccgtggcctcccaaagtgctgattacaggtgtgagccaccatgcccagccatgtcatttcatttaaagtcacaatttccatgaatctcaacaagtgaggacctgctatattttgttgcatgcagtttttctttacggacactaaaaggccccatacttaagattccatctactttaagtttaaaggattttcagaatcaccttaagtgtcaaatttgttagcaggattaattgatatgaattcacttattaaacagtaaactcaaataacatagacatcaaataacagacatctgctctagttaatgataaaatgtttatagattttatcaggtggttagtttgaaactaaatggtttacatctaaattaagggcaggagctgtctttcagacattcaaaacgcatttgtgtaaaatgacaggtgtttggtattaccaggaactcataatgacattttaataattattgtctaaatttcataatcgaagcgattttagagtagttaacttgagatttcacagccagtaaatggctgtatttctccagagctctcagctcccatgtttattcagccaacgaacaaaccagactgcagactgtattagagcaagacaacatcatttagccattgatttttatcttctaccttgaatgaattgaatgaagaaaatgtcttttagggataaacactatcaaggatgaattttatactaaggttatatgaaagaaaaatctcaaaaccactaagccaaagggaagtcaagctgggaactgattgaggcaaacctgcctcccattttattcctaaataagacagccacaaagataaaatttgctcacaagggaattccttatggacaaagaactcaaagtcttcacatgaaacaaatgcataaatgattgctttctctgtttcatgtttcactaagccagattaaggtataactgactattcctctactctcctctcacatgtaaattgtatattcagtgaaaggctaatcagaaactcaaaaaaatgcaaccctttctctcttacctgcctatgcttgaagcccccgcccctcttcaagttgtcctgcctttcaagaccaatgtacaccttacacatactgattgatgtctcatgtctctctaaaatgtgtaaaaccaagctgtgccccaaccaccttgggcacatgtggtgaggacctcctgaggctgtgtcatgggcacaccttaaccctgggaaaataaactttctaaactg

SEQ ID NO: 287576 - DNA, 2212 bp, Homo sapiens
  misc_feature (48)..(48): n is a, c, g, or t
  misc_feature (56)..(56): n is a, c, g, or t
acatatttactaattccacccccatttgatttacgactttatgtgaancctatagnaaatcgttttggcaaaatgttatggtggtgatattacccgaaaaatgaagcttttgaagagacaagcagaagggaaaaaaaagctgaggaaaattggcaacgttgaagttccaaaagatgcttttataaaagttctgaaaacacaatcttctaaataattggtgggaaaacaaagaattttcattgcaatttgtaatatgctgacaacagaaagaaaattataaaatttgcttgttactttcagggtattcaggttcaaataacctactagtctttcgttgaaagggagtagttagtgggtaggcaagagcttagattttgaagccatgttgcctgttctcaaatatctgttccaaccactcactagtaaggtgaccgtggccagattaacctttgtttcctcttcagtaaaatcgagattatactactacctacataagttgttgttgtgaagattaaatgaggtaatacgttaaatattcagaggtgcaagacacatagtaagcactcaattgtaactacagttaagtccttaaatgccatcgaaaggttcttagaaactgactttaagcaaaatgacacgtagcacaatgttcttgaatgatgtcatttccttaagtggtttgtaacatcgatgaggaaaaaaaattggtttatgcgtcatttcattttatttttatttattttttgagacagagtcttgccctgtcgcccaggctggagtgcaatggcacaatctcgactcactgcaacctctgcctcctgggttcaagagattctcctgcctcagcctccattacaggcgtgcaccaccatgctcggctaattttttgtatctttagtagagtcggggtttcaccatgttggccaggctggtcttgaactcctgacctcgtgatccacccaccgtggcctcccaaagtgctgattacaggtgtgagccaccatgcccagccatgtcatttcatttaaagtcacaatttccatgaatctcaacaagtgaggacctgctatattttgttgcatgcagtttttctttacggacactaaaaggccccatacttaagattccatctactttaagtttaaaggattttcagaatcaccttaagtgtcaaatttgttagcaggattaattgatatgaattcacttattaaacagtaaactcaaataacatagacatcaaataacagacatctgctctagttaatgataaaatgtttatagattttatcaggtggttagtttgaaactaaatggtttacatctaaattaagggcaggagctgtctttcagacattcaaaacgcatttgtgtaaaatgacaggtgtttggtattaccaggaactcataatgacattttaataattattgtctaaatttcataatcgaagcgattttagagtagttaacttgagatttcacagccagtaaatggctgtatttctccagagctctcagctcccatgtttattcagccaacgaacaaaccagactgcagactgtattagagcaagacaacatcatttagccattgatttttatcttctaccttgaatgaattgaatgaagaaaatgtcttttagggataaacactatcaaggatgaattttatactaaggttatatgaaagaaaaatctcaaaaccactaagccaaagggaagtcaagctgggaactgattgaggcaaacctgcctcccattttattcctaaataagacagccacaaagataaaatttgctcacaagggaattccttatggacaaagaactcaaagtcttcacatgaaacaaatgcataaatgattgctttctctgtttcatgtttcactaagccagattaaggtataactgactattcctctactctcctctcacatgtaaattgtatattcagtgaaaggctaatcagaaactcaaaaaaatgcaaccctttctctcttacctgcctatgcttgaagcccccgcccctcttcaagttgtcctgcctttcaagaccaatgtacaccttacacatactgattgatgtctcatgtctctctaaaatgtgtaaaaccaagctgtgccccaaccaccttgggcacatgtggtgaggacctcctgaggctgtgtcatgggcacaccttaaccctgggaaaataaactttctaaactg

SEQ ID NO: 287577 - DNA, 2211 bp, Homo sapiens
  misc_feature (47)..(47): n is a, c, g, or t
  misc_feature (55)..(55): n is a, c, g, or t
gtattgaattcctgtagtgaacatggactaatacaagttatgtgaancctatagnaaatcgttttggcaaaatgttatggtggtgatattacccgaaaaatgaagcttttgaagagacaagcagaagggaaaaaaaagctgaggaaaattggcaacgttgaagttccaaaagatgcttttataaaagttctgaaaacacaatcttctaaataattggtgggaaaacaaagaattttcattgcaatttgtaatatgctgacaacagaaagaaaattataaaatttgcttgttactttcagggtattcaggttcaaataacctactagtctttcgttgaaagggagtagttagtgggtaggcaagagcttagattttgaagccatgttgcctgttctcaaatatctgttccaaccactcactagtaaggtgaccgtggccagattaacctttgtttcctcttcagtaaaatcgagattatactactacctacataagttgttgttgtgaagattaaatgaggtaatacgttaaatattcagaggtgcaagacacatagtaagcactcaattgtaactacagttaagtccttaaatgccatcgaaaggttcttagaaactgactttaagcaaaatgacacgtagcacaatgttcttgaatgatgtcatttccttaagtggtttgtaacatcgatgaggaaaaaaaattggtttatgcgtcatttcattttatttttatttattttttgagacagagtcttgccctgtcgcccaggctggagtgcaatggcacaatctcgactcactgcaacctctgcctcctgggttcaagagattctcctgcctcagcctccattacaggcgtgcaccaccatgctcggctaattttttgtatctttagtagagtcggggtttcaccatgttggccaggctggtcttgaactcctgacctcgtgatccacccaccgtggcctcccaaagtgctgattacaggtgtgagccaccatgcccagccatgtcatttcatttaaagtcacaatttccatgaatctcaacaagtgaggacctgctatattttgttgcatgcagtttttctttacggacactaaaaggccccatacttaagattccatctactttaagtttaaaggattttcagaatcaccttaagtgtcaaatttgttagcaggattaattgatatgaattcacttattaaacagtaaactcaaataacatagacatcaaataacagacatctgctctagttaatgataaaatgtttatagattttatcaggtggttagtttgaaactaaatggtttacatctaaattaagggcaggagctgtctttcagacattcaaaacgcatttgtgtaaaatgacaggtgtttggtattaccaggaactcataatgacattttaataattattgtctaaatttcataatcgaagcgattttagagtagttaacttgagatttcacagccagtaaatggctgtatttctccagagctctcagctcccatgtttattcagccaacgaacaaaccagactgcagactgtattagagcaagacaacatcatttagccattgatttttatcttctaccttgaatgaattgaatgaagaaaatgtcttttagggataaacactatcaaggatgaattttatactaaggttatatgaaagaaaaatctcaaaaccactaagccaaagggaagtcaagctgggaactgattgaggcaaacctgcctcccattttattcctaaataagacagccacaaagataaaatttgctcacaagggaattccttatggacaaagaactcaaagtcttcacatgaaacaaatgcataaatgattgctttctctgtttcatgtttcactaagccagattaaggtataactgactattcctctactctcctctcacatgtaaattgtatattcagtgaaaggctaatcagaaactcaaaaaaatgcaaccctttctctcttacctgcctatgcttgaagcccccgcccctcttcaagttgtcctgcctttcaagaccaatgtacaccttacacatactgattgatgtctcatgtctctctaaaatgtgtaaaaccaagctgtgccccaaccaccttgggcacatgtggtgaggacctcctgaggctgtgtcatgggcacaccttaaccctgggaaaataaactttctaaactg

SEQ ID NO: 287578 - DNA, 2218 bp, Homo sapiens
  misc_feature (54)..(54): n is a, c, g, or t
  misc_feature (62)..(62): n is a, c, g, or t
tatgatcttctataattattttctcactttttttgttatcccccctgtgtgaancctatagnaaatcgttttggcaaaatgttatggtggtgatattacccgaaaaatgaagcttttgaagagacaagcagaagggaaaaaaaagctgaggaaaattggcaacgttgaagttccaaaagatgcttttataaaagttctgaaaacacaatcttctaaataattggtgggaaaacaaagaattttcattgcaatttgtaatatgctgacaacagaaagaaaattataaaatttgcttgttactttcagggtattcaggttcaaataacctactagtctttcgttgaaagggagtagttagtgggtaggcaagagcttagattttgaagccatgttgcctgttctcaaatatctgttccaaccactcactagtaaggtgaccgtggccagattaacctttgtttcctcttcagtaaaatcgagattatactactacctacataagttgttgttgtgaagattaaatgaggtaatacgttaaatattcagaggtgcaagacacatagtaagcactcaattgtaactacagttaagtccttaaatgccatcgaaaggttcttagaaactgactttaagcaaaatgacacgtagcacaatgttcttgaatgatgtcatttccttaagtggtttgtaacatcgatgaggaaaaaaaattggtttatgcgtcatttcattttatttttatttattttttgagacagagtcttgccctgtcgcccaggctggagtgcaatggcacaatctcgactcactgcaacctctgcctcctgggttcaagagattctcctgcctcagcctccattacaggcgtgcaccaccatgctcggctaattttttgtatctttagtagagtcggggtttcaccatgttggccaggctggtcttgaactcctgacctcgtgatccacccaccgtggcctcccaaagtgctgattacaggtgtgagccaccatgcccagccatgtcatttcatttaaagtcacaatttccatgaatctcaacaagtgaggacctgctatattttgttgcatgcagtttttctttacggacactaaaaggccccatacttaagattccatctactttaagtttaaaggattttcagaatcaccttaagtgtcaaatttgttagcaggattaattgatatgaattcacttattaaacagtaaactcaaataacatagacatcaaataacagacatctgctctagttaatgataaaatgtttatagattttatcaggtggttagtttgaaactaaatggtttacatctaaattaagggcaggagctgtctttcagacattcaaaacgcatttgtgtaaaatgacaggtgtttggtattaccaggaactcataatgacattttaataattattgtctaaatttcataatcgaagcgattttagagtagttaacttgagatttcacagccagtaaatggctgtatttctccagagctctcagctcccatgtttattcagccaacgaacaaaccagactgcagactgtattagagcaagacaacatcatttagccattgatttttatcttctaccttgaatgaattgaatgaagaaaatgtcttttagggataaacactatcaaggatgaattttatactaaggttatatgaaagaaaaatctcaaaaccactaagccaaagggaagtcaagctgggaactgattgaggcaaacctgcctcccattttattcctaaataagacagccacaaagataaaatttgctcacaagggaattccttatggacaaagaactcaaagtcttcacatgaaacaaatgcataaatgattgctttctctgtttcatgtttcactaagccagattaaggtataactgactattcctctactctcctctcacatgtaaattgtatattcagtgaaaggctaatcagaaactcaaaaaaatgcaaccctttctctcttacctgcctatgcttgaagcccccgcccctcttcaagttgtcctgcctttcaagaccaatgtacaccttacacatactgattgatgtctcatgtctctctaaaatgtgtaaaaccaagctgtgccccaaccaccttgggcacatgtggtgaggacctcctgaggctgtgtcatgggcacaccttaaccctgggaaaataaactttctaaactg

SEQ ID NO: 287579 - DNA, 2170 bp, Homo sapiens
agacgtcggcaagctgcgccgccgcttcgggttgcttccggatctggtacttgggcagagctccccggggttcattgtcttcgcttcacaggatctgtttgagtcctgtccaccggatcctacggggggtaccttcgaaaaaaaacgggctatgctgctgttgcgtgtgggtaccctctcctgacgcctccgccgcccgggtcatgtggaccctcgtgggtcggggctgggggtgcgcacgcgctctcgcgccacgagccactggggccgcgcttctggtggccccggggccccggtccgcgccgacccttggggctgctccagagtcctgggctaccgacaggctctacagctccgcagaattcaaggaaaaacctgacatgtctaggtttcctgttgaaaatattagaaatttcagtattgttgcacacgtggatcatggcaaaagtactttagctgacaggctcctagaacttacagggacaattgataaaacaaagaataataagcaggttcttgataaattgcaagtggaacgagaaagaggaatcactgttaaagcacagacagcatctctcttttacaattgtgaaggaaagcagtaccttttaaatctcattgatacaccgggccatgttgattttagttatgaagtatccaggtcactttctgcttgccagggtgttttacttgtggttgatgcaaatgagggaattcaagcccaaactgtagcaaacttctttcttgccttcgaagcacagctatcggtaattccagttataaataagatagatctgaagaatgctgatcctgaaagggttgaaaaccaaattgagaaagtgtttgatattccaagtgatgaatgtattaagatttctgctaaacttggaacaaatgttgagagtgttcttcaggcaattattgaaagaatcccccctcctaaagtgcatcgcaaaaatcctctgagagctttggtatttgactccacctttgaccagtatagaggtgtgatagccaatgtagcattatttgacggagtggtttccaaaggagataaaattgtatctgcacatactcaaaagacatacgaagttaatgaagtaggagtcttgaatcctaatgagcagccaactcataaattgaatgtatcctctagaccaatctgaatataacaatctgaagagtgctatagaaaaactgactttaaatgattccagtgtgaccgttcatcgggatagtagccttgctctgggtgctggctggaggctaggatttcttggacttttgcacatggaagttttcaaccagcgactggagcaagaatataatgcttctgttattttaacaacccctactgttccatataaagctgtactgtcatcatcaaaattgataaaggaacatagagaaaaagaaattacaattatcaatcctgcacaattccccgataaatcaaaagtaacagaatatttggagccagttgttttgggcactattatcacaccagatgaatacactggaaaaataatgatgctttgcgaggctcgaagagcagttcagaagaatatgatatttattgatcaaaatagagttatgcttaaatatctctttcctttgaatgaaattgtggtagatttttatgactctttgaaatccctatcttctggatatgctagttttgattacgaagatgcaggctaccagactgcagaacttgtaaaaatggatattctactgaatggaaatactgtagaggagctagtaactgttgtacacaaagacaaagctcattcaattggcaaagccatatgtgaacggctgaaggattctcttcctaggcaactgtttgagatagcaattcaagctgctattggaagtaaaatcattgcaagagaaactgtgaaagcctataggaaaaacgttttggcaaaatgttatggtggtgatattacccgaaaaatgaagcttttgaagagacaagcagaagggaaaaaaaagctgaggaaaattggcaacgttgaagttccaaaagatgcttttataaaagttctgaaaacacaatcttctaaataattggttctgataaaaacagatgaaatctgaaagaccatgacagtagtattttgaaaatgacagtatttgaaattaaaaaattgtaaaagtgttctgt

SEQ ID NO: 287580 - DNA, 2029 bp, Homo sapiens
agacgtcggcaagctgcgccgccgcttcgggttgcttccggatctggtacttgggcagagctccccggggttcattgtcttcgcttcacaggatctgtttgagtcctgtccaccggatcctacggggggtaccttcgaaaaaaaacgggctatgctgctgttgcgtgtgggtaccctctcctgacgcctccgccgcccgggtcatgtggaccctcgtgggtcggggctgggggtgcgcacgcgctctcgcgccacgagccactggggccgcgcttctggtggccccggggccccggtccgcgccgacccttggggctgctccagagtcctgggctaccgacaggctctacagctccgcagaattcaaggaaaaacctgacatgtctaggtttcctgttgaaaatattagaaatttcagtattgttgcacacgtggatcatggcaaaagtactttagctgacaggctcctagaacttacagggacaattgataaaacaaagaataataagcaggttcttgataaattgcaagtggaacgagaaagaggaatcactgttaaagcacagacagcatctctcttttacaattgtgaaggaaagcagtaccttttaaatctcattgatacaccgggccatgttgattttagttatgaagtatccaggtcactttctgcttgccagggtgttttacttgtggttgatgcaaatgagggaattcaagcccaaactgtagcaaacttctttcttgccttcgaagcacagctatcggtaattccagttataaataagatagatctgaagaatgctgatcctgaaagggttgaaaaccaaattgagaaagtgtttgatattccaagtgatgaatgtattaagatttctgctaaacttggaacaaatgttgagagtgttcttcaggcaattattgaaagaatcccccctcctaaagtgcatcgcaaaaatcctctgagagctttggtatttgactccacctttgaccagtatagaggtgtgatagccaatgtagcattatttgacggagtggtttccaaaggagataaaattgtatctgcacatactcaaaagacatacgaagttaatgaagtaggagtcttgaatcctaatgagcagccaactcataaattgaatgtatcctctagaccaatctgaatataacaatctgaagagtgctatagaaaaactgactttaaatgattccagtgtgaccgttcatcgggatagtagccttgctctgggtgctggctggaggctaggatttcttggacttttgcacatggaagttttcaaccagcgactggagcaagaatataatgcttctgttattttaacaacccctactgttccatataaagctgtactgtcatcatcaaaattgataaaggaacatagagaaaaagaaattacaattatcaatcctgcacaattccccgataaatcaaaagtaacagaatatttggagccagttgttttgggcactattatcacaccagatgaatacactggaaaaataatgatgctttgcgaggctcgaagagcagttcagaagaatatgatatttattgatcaaaatagagttatgcttaaatatctctttcctttgaatgaaattgtggtagatttttatgactctttgaaatccctatcttctggatatgctagttttgattacgaagatgcaggctaccagactgcagaacttgtaaaaatggatattctactgaatggaaatactgtagaggagctagtaactgttgtacacaaagacaaagctcattcaattggcaaagccatatgtgaacggctgaaggattctcttcctaggcaactgtttgagatagcaattcaagctgctattggaagtaaaatcattgcaagagaaactgtgaaagcctataggaaaaacgttttggcaaaatgtgttctgataaaaacagatgaaatctgaaagaccatgacagtagtattttgaaaatgacagtatttgaaattaaaaaattgtaaaagtgttctgt

SEQ ID NO: 287581 - DNA, 1484 bp, Homo sapiens
agacgtcggcaagctgcgccgccgcttcgggttgcttccggatctggtacttgggcagagctccccggggttcattgtcttcgcttcacaggatctgtttgagtcctgtccaccggatcctacggggggtaccttcgaaaaaaaacgggctatgctgctgttgcgtgtgggtaccctctcctgacgcctccgccgcccgggtcatgtggaccctcgtgggtcggggctgggggtgcgcacgcgctctcgcgccacgagccactggggccgcgcttctggtggccccggggccccggtccgcgccgacccttggggctgctccagagtcctgggctaccgacaggctctacagctccgcagaattcaaggaaaaacctgacatgtctaggtttcctgttgaaaatattagaaatttcagtattgttgcacacgtggatcatggcaaaagtactttagctgacaggctcctagaacttacagggacaattgataaaacaaagaataataagcaggttcttgataaattgcaagtggaacgagaaagaggaatcactgttaaagcacagacagcatctctcttttacaattgtgaaggaaagcagtaccttttaaatctcattgatacaccgggccatgttgattttagttatgaagtatccaggtcactttctgcttgccagggtgttttacttgtggttgatgcaaatgagggaattcaagcccaaactgtagcaaacttctttcttgccttcgaagcacagctatcggtaattccagttataaataagatagatctgaagaatgctgatcctgaaagggttgaaaaccaaattgagaaagtgtttgatattccaagtgatgaatgtattaagatttctgctaaacttggaacaaatgttgagagtgttcttcaggcaattattgaaagaatcccccctcctaaagtgcatcgcaaaaatcctctgagagctttggtatttgactccacctttgaccagtatagaggtgtgatagccaatgtagcattatttgacggagtggtttccaaaggagataaaattgtatctgcacatactcaaaagacatacgaagttaatgaagtaggagtcttgaatcctaatgagcagccaactcataaattgtaagtaatctgcattagtaaaattaaaatgcatttgtatgtggttctatttctgcatttttctcaacttggtatgcttagaatgatcctcatttggtaacttaaaaaagacaatagaaacgtcagttgatactttttttattctaaatgactagttataactagatttatgatcaagggtagattggatcctatatcgatgtatttgatgagacaatgaaagagttagttccctccacccatatccatattaggtatcatttttgacatttcttcataactagattttccaatgtaaaggtggtataatagaaaccttaataaatctttagtgtggaattca

SEQ ID NO: 287582 - DNA, 814 bp, Homo sapiens
agaaattgatttatacatgtaaactcaaaagactttttacaaagatgctaaggtaactcagtgggaaaggacagtcttttcaacaaatggtccgggactattagatacctgtatccacagcgttgaccttgaccctttgcaccatacacaaaagtaacttggaatgcatcacagtcgttcatggctaatatgcagaaatacaactgatttttcttattgaccttatataacttcaaacttgctaaactcacttattctagtagctttctatagctttctcaaaattgtcaacataggcaaccaggttgtctatagagttttacttcctttttaatctacatgcccttcatttccttttaatgctttacggcactgaaaaggaccctccagtacaatgcttactggaaggtgtgagactagacatcttaccctgttcctgatcttagatggaaacctgaatctaagagctgaaactataaaacatatagaagaatatgctggagaaaatcttaatgaccttgggtaaagatttttttagataggacatagaaaatatgaatcagaaaggaaagaaagagataaattagacttcaaattacaaattctgctctttaaaaggtactttttataaaatgaaaaggcaagtcatacactaaaatattgataaaacatgcatctgacccatcatgaggtataatatataatcaagttcaaaatatatagagaattctcatataacatatgtatgtatatatatataaaataataggctgggtatggtggttcacacctgtaatcccagcactttgggtgg

SEQ ID NO: 287583 - DNA, 1230 bp, Homo sapiens
  misc_feature (1229)..(1229): n is a, c, g, or t
ggcaaaggacgaaggtcagataaactttgagtatcattttattatatagttttttaaaaaatctgaagttcatgttacaagagaccactgcaaaattcaaacttgtttagatttccttagccttcaaaggatgtttaagaacatttccttatctctatcctctcccacccctacagttatcgaatcagctcctctaggtttttctagctctactacagctcagaataattttgataccttactctttttttttgtttgtttgtttgagatggagtctcgcactgttgcctgggctggagcgcagtggcgcaatcttggcttactgcaacctctgccttcctggttcaagcgattctcctggtcagcctcccgagtagctgggactataggtgcccgccaccatgcctggctaattttttgtatttttagtagagacagagacgaggtttcactatgttggccaggctggtcttgaatgcgtgacctgcttcggcctcccaaactgctgggattataggtgtgagccactgtgcccagccaataccttactctctattagtgctaaagttatttccgttttccctcctgatgtattttaccctctatgttttaatttttattcccagaactaccctgtagttcaggcccctcatatcacactcctggacacttagaatcttgtttccatgttgtgcaacactactgtagaagaatctcccttgaactacccacatttagtgtatcattcattgaccaagagcataatggtgtcttccttctggctccaagctgcctttcctgccttatcttccattattttcctcataaagcattgctccagctaatcttatctatttttctccagaatctccatccccttcccgtcagatacatctaaaactttttttgtatctttgtttttcctcgtgttgtatcatcttcctaaaacatgttctacttgtgaaaaccctaagaaattctctctgtcttattgaaattctatctccactgtgaagcattatcatggtgtggccatatatgatctatccctatctgaagtcactgcatttattccctgatcctcatttgcaggtccagtaccttgtacaagtttctttttgtgccatattagactgtaagctccaagagggcagggcccaagtcttatgaatttgtgtctgcatagtgtctagtacttgtctgaggcccacaataaaattcttttgaang

SEQ ID NO: 287584 - DNA, 1081 bp, Homo sapiens
aagtatatgtataaacccgatttaatttccaaaaagtcaaattggaatttgccgggtgtattccaatcaagcccccttaaaacggggtctaataaaccaattcccaagagccctttcttaaagttaagaaccgaacgggccattaaaaaataccatggctgaacaaaacacacccacagccactgacccatccaggactccagagagtcaggtcaaccccgaggaccccttgggcccttctggggtactcctttcggcccccctggtagagtctcgggagttcacacagggtggcaaacaccccctagagctcctctgcctgaatcctgccccctagcctttgaccactgtcagccacctgtgtcccttgagccttcgggtcttcacttcccacttggacatcactgctggacattcccatcgagatgacacctgggttccaatcccagctctgcctttgaagcacttgcggccaccgtcaagtccctttgctctcggaccctgggtttctcatcctttaatgaggtgggttcagaagctctcccatcttcacagcaaccctggcactggcttctcaatgggagggaagcagcagagaaactgaagtgttagacactatgtgtcccaccaccccattacagagacatatgacaatgttcagcaggtcatctttaatgcagaggaggagatgggatgtcactcgctgtctggaggcacgtgggtggtgtgcgggccctcactggccagcctctgggtggccccgcctatcccagtatgaacgtagccaactcaagccctctactgtgtctcctgcagggagagggaggcctcggcacctcagcccacaaggagaaaacagcccctgtccgggtccctccagagctcccttccccagggccacgcctcacctcgaggctgatactcacagcccacgaagcctttgtagccttcatcttccagcagttgaaacagataggggaaattcagctctccggggctgctgggctcccctcggcctgggacctgtgccacctgcacatgccctggggacagatgtggacaaatgtggggtccaggctcc

SEQ ID NO: 287585 - DNA, 496 bp, Homo sapiens
  misc_feature (16)..(16): n is a, c, g, or t
  misc_feature (21)..(23): n is a, c, g, or t
  misc_feature (27)..(27): n is a, c, g, or t
agcgcagggccgaatnccaannnggcnggctgtcaactcacagctgtccatgctgttcacagaggagtgtgacaaggtgcgggacctgatgcacgtgcactcgttcagctatgacttccatctgcgcctcgtgcatcagcacgtgctaggtgcccatctggtgctgcggcacggctaccacctcaccacctttctgcgacacttcctggcccaccaccctgacggaccccactttggccgcaatcacatttaccaagggacattggagctccccacaccactcattgctgcccaccagctatacaactacgtggcttccggaagcggcgcatgtcagcagtgagcctggggaagagctctcgctggctggtgagcaccacgaagaactgtagccgcagaacgtgccgttcagcctctccttgctcctcaaagggtgcagcacagtgacagacaagcagagacacatcaaagtcatcctggtgtcgaagtccctcag

SEQ ID NO: 287586 - DNA, 470 bp, Homo sapiens
gtggtgggtgtgtggggccctatacctcagtcctgacttcctattcctcagaccctgacagccagcccccaagcacctgggtccccagaggattctgagggtgtccccctcatcagcctgccccgcgtgccacagggagggagtcagcctgggcccagccggggattaagtctcatgtccagtcagggcagtgtggactcagaccacctaggttatgatggtggcagcagtggctcagacagtgagggtcccaatgacacccttggtgagaaggcccccttcacattgcggactccacctgggccagcacctccacagagagagcgtcacagctcccagatgatcagtaacccccccacagagagagcgtcacagctcccagatgatcagtaacccccccacagagagagcgtcacagctcccagatgatcgacccccccacagagagagctcgggatcctcagatcaac

SEQ ID NO: 287587 - DNA, 7696 bp, Homo sapiens
  misc_feature (1090)..(1090): n is a, c, g, or t
  misc_feature (1106)..(1106): n is a, c, g, or t
  misc_feature (3651)..(3651): n is a, c, g, or t
aggcagctaaccactgtgccctgctgcaggagcatgcacagcggtgctatgtccgtgggctattccgcagcttgcagcaagcacagagtgtgacctcccaggatttgctgacagcggtagatgcctgtgaggagctactacaagaaatagacatcaccccatttctccttgcattgtgtggccacacttggggtttgcctcatgcacccccaagtcctggtcctctcagccctgggcccttcagcagcagcatggaggagggtgctgaacctcgggaacgagctatcctagcttctgaatccagcatagagaccgaggacctaagcgagcctgagtttcagagcacccgtgtccctggcattccagaccctgggccagagatctctctgacagatgtctgccagctcagaggagaggcccatggtgcccttcatagcgtcatccaggtgggaagcttgggtgagggtagaagaggtgttagagtcctgcctgtgcagagggacaggattctctcctgggcggggggtatgcatgtgtcctgctctagggtagggagtagtatcctgttgaggggtgactgacattctaacctccttctaaaccccacaacaggagaagttcctagagatcagtcgtctccacttccgcacagtgccttccaatccccactacttcttctattgccctccatccagcaggcgagaagatgaggggcctcgggacacagtagacagaaaaatcagtgacctggagttttcagaggctgagcttatgggagaagaaggagacacatctgcctgctgtgtggtcactgagagtgacccagagctagaggtagaataccgggagagccgtgaatcagacctggggcctgctgggctagactctgcctcgctgtcagacgtagacactgtgaatcctgatgaagactccttcagtatcttggggggcgactcacccactgggcctgagagcttccttcatgacctgccaccgctcttcctgcacctcacgtgctccgtgcggctacgtgggcagcacagctcagtacctgtgtgcagcctgcctacctgcctggtttccagtctgnagggccccccagttgnaggccgagttcccttgagggacctcagtgtgactctggatgtcttcatgctgactttgcccctggaagtggagctccccacggcctcggaccctcagcaccaccggtcaacatctgaaagcagtgcttcatttccacgatccccagggcagccatcatctttaaggtcagatgatggcctcgggcccccactgccacccccagaagaggagaggcacccaggactatccaatttggccacgccccacagactggctattgagaccaccatgaatgagatccgctggttgttggaagatgagatggtgggggcactccgaagagggggcatcccacagagtcctgccctgcaccgcgcagctgcccatatccatagttctcctggacgctccacctgccttcgccaaactctgccactgagttttgtatttgggccagagcgttccctcacacaattcaaggaggagttccgccgcctccatctccctggccatgttcttcttgaagaccctgacagtggcttcttctttgtggcagctggccaacagccaggtgggtcccatggggagccttcttcagcggcctgggcttggcacagtcatgaggacagggctgaaggcatcgaaggggagaccctgacagccagcccccaagcacctgggtccccagaggattctgagggtgtccccctcatcagcctgccccgcgtgccacagggagggagtcagcctgggcccagccggggattaagtctcatgtccagtcagggcagtgtggactcagaccacctaggttatgatggtggcagcagtggctcagacagtgagggtcccaatgacacccttggtgagaaggcccccttcacattgcggactccacctgggccagcacctccacagccttcactctcaggcctccctgggccctgcctgcctgacttctggctcattgtccgggtcctgcaggaccgtgtggaagtgtatgcacatgcacggagcctgattcgggaggatggggggccgggcactgagtgtcgccacctgcagcagctcctggtgaggcgagttggggagatctgcagggaggtcaaccagcgactgcttcttcaagaccttcatgacagccacgtgtgtaactctcttctggtggccgagagtgaagaagatctgtggcgcagtgagactcccttccactcccgtcagcgggcaccactgcccagtgatgattatgctgctgatgagagctgtgcgccccgtgggtacctggcagccacaatgcagtttgtccctggccatttctcctgtgacgttgtgtggggaactgtgatccgagtccattcacgcctcaaaatggggcccagcatgggggtctctcgggccatccaggccctgcgctctgtgctcaatgccttctctgtggtgaaccggaaaaacatgtttgtttaccaggagcgagcaacaaaggctgtgtactatcttcggctcctagagacatcctgcagtgaccggccatggaaaggggatgcgctgcccccttccctcgctctgtcccgaagccaagagcccatctactctgaggaagcctcgggtcctcgttctcccttagacatggtctctagccgcagttcagatgctgctcgtcctgtgggccaagtggacagacatatccagctgctggtccatggtgttgggcaggcaggtcctgagatcacggatgagctcgtgcgagttctatgtcggcgcctggatgaggccacgctggacgtcatcacagttatgcttgttcggaactgcaagctgacaccagctgatgtggagttcatccagccccctggaagtctcccctcagaggtgctgcatctggccctacccacctcctgcaggccctggcttccagccctggcatggtacctacggcagaacttgctcatcttcctgcactctcccaagtacacagatagcaacagccggaaccacttccaacatccactcccaccacagggtggcctccctgacttggacatctacttgtataacaagcctggtggacagggcactgggggcaaaggggttgcctgcatcactctagcctttgtggatgaaggaggggcccccttgtcactggcgttgtggcccccctcctctccggggcccccagacccactgcgagaggaggaatttgagcaactgacccaggtcatccgctgcccggttgttgtggacagttcttcagctcagaatggggccccacggcttcgattggatgtgtgggaaaaggggaacattagtattgtgcagctggaggagaaactccgaggagcagctcgccaggccctggccgatgccatcatcgagcttcagctgctgccagcttcactatgtacagaggacacacccacaggaagtctcaggaacggatcgttggaaactaagagctctgcaggccgagctagcacctttccccctgcccctgtccctggggagcctgtgactccacccagcaaagcgggccggcgtagcttctgggatatgctgagtaaaacagantgtggggatttgggttcccccaaaacaactgatgacattgtcctggatcggccagaagacactcggggccggaggcgtcacaaaaccgagagtgttcggactcctggtggagctgagcgggcgccaggctcagattctggagcccagagacaaaagcgccggacaacacagctagaagagggtgaggtggggacccttcatcctgtgtttgcccgtgttgctcagcgctggatggagtttatggttcagattggttgtgcctcagtgtccagaagctctgcccacatggtgtcccggttcctccttccatccatcctgtctgagttcaccgcactggtcacctcaatggctggagacaccagtgtccgcatctttgagcagcatttgggttcagagccagagatcttcggcccttgttcccctgggcaactgggcccctctccccgccctgcagctgagcggcatctgctgcttctgggaaggaacttcttgcagtggaggagaccaacacagcaggctgccaaagccatgcagcgcttcgagccaggaggtgatgggagctcagggcgaaatgctccccggcagaggctcttgctactagaggttgtggacaagaagctacagctgctgacctacaactgggctccagacctgggggcagcattgggccgagcgctggttcgcctggtgcagtggcagaatgcacgagcccatctcatcttctgcctactcagccagaagcttggcctcttccatcattatggccagttggacttccccgtgcgagatgaaaaggagccaaacccattcctgctgccgaccatggaagtggagaccctcatccggagtgcaagtcccccgctgagccgtgagcagggccgactgagtgggtcctctcgtggtgggggtcctcttcccctggacacattcccctttgacgaggccctaagggatatcacggctgcccgccccagctccgtacttggtcctgtgcccagacctcctgatcctgtcacctaccatggacaacagttcctagagatcaagatggcagagcgcagagagctggagcgccagatgaagatggaaaacctgtttgtaacctggcagcagcgttctaccccagccaccatgcccatcagtgctggagagctggagaccctgaagcagtcatcccgcctggtgcattactgtgcaacagccatgctcttcgacccagctgcctggctgcatgggcccccagagacctctggaccccctgacgggcagcggcgccatcgccctgagtcagggtctgggagccgagaggcccccacaagctgtgaatccttggatgtgtcgcccccgggagcccgtgaggagccttggctgaaggagctgagcttggctttcctgcagcaatatgtgcagtatctgcagagcataggttttgtgctggtaccactgcggcccccctcacccgcccgcagcaccagccggccacgggccatggctatccttggaacagagggtcgaggctccttctcctgccctaaaaccaagactgatgggagccccaagagcactagctctccggtaaccacctaccacctgcagcgggcactgcctgggggcatcatcctcatggaactggcattccagggctgttacttctgtgtcaaacagtttgccctggaatgttcccgaatcccaatggggcaggctgtcaactcacagctgtccatgctgttcacagaggagtgtgacaaggtgcgggacctgatgcacgtgcactcgttcagctatgacttccatctgcgcctcgtgcatcagcacgtgctaggtgcccatctggtgctgcggcacggctaccacctcaccacctttctgcgacacttcctggcccaccaccctgacggaccccactttggccgcaatcacatttaccaagggacattggagctccccacaccactcattgctgcccaccagctatacaactacgtggctgatcacgccagctcttaccacatgaagccattgcgaatggcccggccagggggcccagaacacaacgagtatgccctggtgtcggcatggcacagttctggctcctacctggactctgagggacttcgacaccaggatgactttgatgtgtctctgcttgtctgtcactgtgctgcaccctttgaggagcaaggagaggctgagcggcacgttctgcggctacagttcttcgtggtgctcaccagccagcgagagctcttccccaggctcactgctgacatgcgccgcttccggaagccacccagactgccccctgagccagaggctcctgggagttcagctggcagccctggggaggcctcagggcttattctagcgcctggaccggctcctctgttcccaccactggctgcagaggtgggcatggcacgagcacggctggctcagctggtgcggctggctggagggcactgccgtcgggacaccctttggaagcgcctcttcttgctggagccaccggggcctgatcgactgcggctaggggggcgcctggccctggcagagctggaggaactcctagaagcagtccatgccaaatccattggggacatcgacccccagctggactgcttcctatccatgacggtctcctggtaccagagcctgatcaaagttctcctaagccgcttcccccagagctgtcgccatttccaaagcccagacttgggaactcagtacctggttgtgctgaatcagaagttcactgactgctttgtgctagtgtttctggactcccacttaggaaagacgtctctgacagtggttttccgagagcccttcccagtacagccccaggacagcgagagcccccctgcccaactggtctccacctaccaccacctggagtctgtcatcaacacagcctgtttcaccctctggacccgcctcctctgagggagtggactggaccactgaatgtcactgttccttgaatcatgggcctaccagattgcctgccagaggcaggactgaccagcccttctgggccccagggcaagccagacactgagtgacaccaaaggctttgtaactatgtcttgagggtctgctgccccagcctggcagcaggaaccgccctccccaaacacccacagccactgacccatccaggactccagagagtcaggtcaaccccgaggaccccttgggcccttctggggtactcctttcggcccccctggtagagtctcgggagttcacacagggtggcaaacaccccctagagctcctctgcctgaatcctgccccctagcctttgaccactgtcagccacctgtgtcccttgagccttcgggtcttcacttcccacttggacatcactgctggacattcccatcgagatgacacctgggttccaatcccagctctgcctttgaagcacttgcggccaccgtcaagtccctttgctctcggaccctgggtttctcatcctttaatgaggtgggttcagaagctctcccatcttcacagcaaccctggcactggcttctcaatgggagggaagcagcagagaaactgaagtgttagacactatgtgtcccaccaccccattacagagacatatgacaatgttcagcaggtcatctttaatgcagaggaggagatgggatgtcactcgctgtctggaggcacgtgggtggtgtgcgggccctcactggccagcctctgggtggccccgcctatcccagtatgaacgtagccaactcaagccctctactgtgtctcctgcagggagagggaggcctcggcacctcagcccacaaggagaaaacagcccctgtccgggtccctccagagctcccttccccagggccacgcctcacctcgaggctgatactcacagcccacgaagcctttgtagccttcatcttccagcagttgaaacagataggggaaattcagctctccggggctgctgggctcccctcggcctgggacctgtgccacctgcacatgccctggggacagatgtggacaaatgtggggtccaggctcc

SEQ ID NO: 287588 - DNA, 7530 bp, Homo sapiens
  misc_feature (924)..(924): n is a, c, g, or t
  misc_feature (940)..(940): n is a, c, g, or t
  misc_feature (3485)..(3485): n is a, c, g, or t
aggcagctaaccactgtgccctgctgcaggagcatgcacagcggtgctatgtccgtgggctattccgcagcttgcagcaagcacagagtgtgacctcccaggatttgctgacagcggtagatgcctgtgaggagctactacaagaaatagacatcaccccatttctccttgcattgtgtggccacacttggggtttgcctcatgcacccccaagtcctggtcctctcagccctgggcccttcagcagcagcatggaggagggtgctgaacctcgggaacgagctatcctagcttctgaatccagcatagagaccgaggacctaagcgagcctgagtttcagagcacccgtgtccctggcattccagaccctgggccagagatctctctgacagatgtctgccagctcagaggagaggcccatggtgcccttcatagcgtcatccaggagaagttcctagagatcagtcgtctccacttccgcacagtgccttccaatccccactacttcttctattgccctccatccagcaggcgagaagatgaggggcctcgggacacagtagacagaaaaatcagtgacctggagttttcagaggctgagcttatgggagaagaaggagacacatctgcctgctgtgtggtcactgagagtgacccagagctagaggtagaataccgggagagccgtgaatcagacctggggcctgctgggctagactctgcctcgctgtcagacgtagacactgtgaatcctgatgaagactccttcagtatcttggggggcgactcacccactgggcctgagagcttccttcatgacctgccaccgctcttcctgcacctcacgtgctccgtgcggctacgtgggcagcacagctcagtacctgtgtgcagcctgcctacctgcctggtttccagtctgnagggccccccagttgnaggccgagttcccttgagggacctcagtgtgactctggatgtcttcatgctgactttgcccctggaagtggagctccccacggcctcggaccctcagcaccaccggtcaacatctgaaagcagtgcttcatttccacgatccccagggcagccatcatctttaaggtcagatgatggcctcgggcccccactgccacccccagaagaggagaggcacccaggactatccaatttggccacgccccacagactggctattgagaccaccatgaatgagatccgctggttgttggaagatgagatggtgggggcactccgaagagggggcatcccacagagtcctgccctgcaccgcgcagctgcccatatccatagttctcctggacgctccacctgccttcgccaaactctgccactgagttttgtatttgggccagagcgttccctcacacaattcaaggaggagttccgccgcctccatctccctggccatgttcttcttgaagaccctgacagtggcttcttctttgtggcagctggccaacagccaggtgggtcccatggggagccttcttcagcggcctgggcttggcacagtcatgaggacagggctgaaggcatcgaaggggagaccctgacagccagcccccaagcacctgggtccccagaggattctgagggtgtccccctcatcagcctgccccgcgtgccacagggagggagtcagcctgggcccagccggggattaagtctcatgtccagtcagggcagtgtggactcagaccacctaggttatgatggtggcagcagtggctcagacagtgagggtcccaatgacacccttggtgagaaggcccccttcacattgcggactccacctgggccagcacctccacagccttcactctcaggcctccctgggccctgcctgcctgacttctggctcattgtccgggtcctgcaggaccgtgtggaagtgtatgcacatgcacggagcctgattcgggaggatggggggccgggcactgagtgtcgccacctgcagcagctcctggtgaggcgagttggggagatctgcagggaggtcaaccagcgactgcttcttcaagaccttcatgacagccacgtgtgtaactctcttctggtggccgagagtgaagaagatctgtggcgcagtgagactcccttccactcccgtcagcgggcaccactgcccagtgatgattatgctgctgatgagagctgtgcgccccgtgggtacctggcagccacaatgcagtttgtccctggccatttctcctgtgacgttgtgtggggaactgtgatccgagtccattcacgcctcaaaatggggcccagcatgggggtctctcgggccatccaggccctgcgctctgtgctcaatgccttctctgtggtgaaccggaaaaacatgtttgtttaccaggagcgagcaacaaaggctgtgtactatcttcggctcctagagacatcctgcagtgaccggccatggaaaggggatgcgctgcccccttccctcgctctgtcccgaagccaagagcccatctactctgaggaagcctcgggtcctcgttctcccttagacatggtctctagccgcagttcagatgctgctcgtcctgtgggccaagtggacagacatatccagctgctggtccatggtgttgggcaggcaggtcctgagatcacggatgagctcgtgcgagttctatgtcggcgcctggatgaggccacgctggacgtcatcacagttatgcttgttcggaactgcaagctgacaccagctgatgtggagttcatccagccccctggaagtctcccctcagaggtgctgcatctggccctacccacctcctgcaggccctggcttccagccctggcatggtacctacggcagaacttgctcatcttcctgcactctcccaagtacacagatagcaacagccggaaccacttccaacatccactcccaccacagggtggcctccctgacttggacatctacttgtataacaagcctggtggacagggcactgggggcaaaggggttgcctgcatcactctagcctttgtggatgaaggaggggcccccttgtcactggcgttgtggcccccctcctctccggggcccccagacccactgcgagaggaggaatttgagcaactgacccaggtcatccgctgcccggttgttgtggacagttcttcagctcagaatggggccccacggcttcgattggatgtgtgggaaaaggggaacattagtattgtgcagctggaggagaaactccgaggagcagctcgccaggccctggccgatgccatcatcgagcttcagctgctgccagcttcactatgtacagaggacacacccacaggaagtctcaggaacggatcgttggaaactaagagctctgcaggccgagctagcacctttccccctgcccctgtccctggggagcctgtgactccacccagcaaagcgggccggcgtagcttctgggatatgctgagtaaaacagantgtggggatttgggttcccccaaaacaactgatgacattgtcctggatcggccagaagacactcggggccggaggcgtcacaaaaccgagagtgttcggactcctggtggagctgagcgggcgccaggctcagattctggagcccagagacaaaagcgccggacaacacagctagaagagggtgaggtggggacccttcatcctgtgtttgcccgtgttgctcagcgctggatggagtttatggttcagattggttgtgcctcagtgtccagaagctctgcccacatggtgtcccggttcctccttccatccatcctgtctgagttcaccgcactggtcacctcaatggctggagacaccagtgtccgcatctttgagcagcatttgggttcagagccagagatcttcggcccttgttcccctgggcaactgggcccctctccccgccctgcagctgagcggcatctgctgcttctgggaaggaacttcttgcagtggaggagaccaacacagcaggctgccaaagccatgcagcgcttcgagccaggaggtgatgggagctcagggcgaaatgctccccggcagaggctcttgctactagaggttgtggacaagaagctacagctgctgacctacaactgggctccagacctgggggcagcattgggccgagcgctggttcgcctggtgcagtggcagaatgcacgagcccatctcatcttctgcctactcagccagaagcttggcctcttccatcattatggccagttggacttccccgtgcgagatgaaaaggagccaaacccattcctgctgccgaccatggaagtggagaccctcatccggagtgcaagtcccccgctgagccgtgagcagggccgactgagtgggtcctctcgtggtgggggtcctcttcccctggacacattcccctttgacgaggccctaagggatatcacggctgcccgccccagctccgtacttggtcctgtgcccagacctcctgatcctgtcacctaccatggacaacagttcctagagatcaagatggcagagcgcagagagctggagcgccagatgaagatggaaaacctgtttgtaacctggcagcagcgttctaccccagccaccatgcccatcagtgctggagagctggagaccctgaagcagtcatcccgcctggtgcattactgtgcaacagccatgctcttcgacccagctgcctggctgcatgggcccccagagacctctggaccccctgacgggcagcggcgccatcgccctgagtcagggtctgggagccgagaggcccccacaagctgtgaatccttggatgtgtcgcccccgggagcccgtgaggagccttggctgaaggagctgagcttggctttcctgcagcaatatgtgcagtatctgcagagcataggttttgtgctggtaccactgcggcccccctcacccgcccgcagcaccagccggccacgggccatggctatccttggaacagagggtcgaggctccttctcctgccctaaaaccaagactgatgggagccccaagagcactagctctccggtaaccacctaccacctgcagcgggcactgcctgggggcatcatcctcatggaactggcattccagggctgttacttctgtgtcaaacagtttgccctggaatgttcccgaatcccaatggggcaggctgtcaactcacagctgtccatgctgttcacagaggagtgtgacaaggtgcgggacctgatgcacgtgcactcgttcagctatgacttccatctgcgcctcgtgcatcagcacgtgctaggtgcccatctggtgctgcggcacggctaccacctcaccacctttctgcgacacttcctggcccaccaccctgacggaccccactttggccgcaatcacatttaccaagggacattggagctccccacaccactcattgctgcccaccagctatacaactacgtggctgatcacgccagctcttaccacatgaagccattgcgaatggcccggccagggggcccagaacacaacgagtatgccctggtgtcggcatggcacagttctggctcctacctggactctgagggacttcgacaccaggatgactttgatgtgtctctgcttgtctgtcactgtgctgcaccctttgaggagcaaggagaggctgagcggcacgttctgcggctacagttcttcgtggtgctcaccagccagcgagagctcttccccaggctcactgctgacatgcgccgcttccggaagccacccagactgccccctgagccagaggctcctgggagttcagctggcagccctggggaggcctcagggcttattctagcgcctggaccggctcctctgttcccaccactggctgcagaggtgggcatggcacgagcacggctggctcagctggtgcggctggctggagggcactgccgtcgggacaccctttggaagcgcctcttcttgctggagccaccggggcctgatcgactgcggctaggggggcgcctggccctggcagagctggaggaactcctagaagcagtccatgccaaatccattggggacatcgacccccagctggactgcttcctatccatgacggtctcctggtaccagagcctgatcaaagttctcctaagccgcttcccccagagctgtcgccatttccaaagcccagacttgggaactcagtacctggttgtgctgaatcagaagttcactgactgctttgtgctagtgtttctggactcccacttaggaaagacgtctctgacagtggttttccgagagcccttcccagtacagccccaggacagcgagagcccccctgcccaactggtctccacctaccaccacctggagtctgtcatcaacacagcctgtttcaccctctggacccgcctcctctgagggagtggactggaccactgaatgtcactgttccttgaatcatgggcctaccagattgcctgccagaggcaggactgaccagcccttctgggccccagggcaagccagacactgagtgacaccaaaggctttgtaactatgtcttgagggtctgctgccccagcctggcagcaggaaccgccctccccaaacacccacagccactgacccatccaggactccagagagtcaggtcaaccccgaggaccccttgggcccttctggggtactcctttcggcccccctggtagagtctcgggagttcacacagggtggcaaacaccccctagagctcctctgcctgaatcctgccccctagcctttgaccactgtcagccacctgtgtcccttgagccttcgggtcttcacttcccacttggacatcactgctggacattcccatcgagatgacacctgggttccaatcccagctctgcctttgaagcacttgcggccaccgtcaagtccctttgctctcggaccctgggtttctcatcctttaatgaggtgggttcagaagctctcccatcttcacagcaaccctggcactggcttctcaatgggagggaagcagcagagaaactgaagtgttagacactatgtgtcccaccaccccattacagagacatatgacaatgttcagcaggtcatctttaatgcagaggaggagatgggatgtcactcgctgtctggaggcacgtgggtggtgtgcgggccctcactggccagcctctgggtggccccgcctatcccagtatgaacgtagccaactcaagccctctactgtgtctcctgcagggagagggaggcctcggcacctcagcccacaaggagaaaacagcccctgtccgggtccctccagagctcccttccccagggccacgcctcacctcgaggctgatactcacagcccacgaagcctttgtagccttcatcttccagcagttgaaacagataggggaaattcagctctccggggctgctgggctcccctcggcctgggacctgtgccacctgcacatgccctggggacagatgtggacaaatgtggggtccaggctcc

SEQ ID NO: 287589 - DNA, 6629 bp, Homo sapiens
  misc_feature (2584)..(2584): n is a, c, g, or t
gacctttttagggtagggggaccactaagcgaatctagagcacttggggactaaggagaccttgaggagtccaagaatgaagtaaggaggaggccctggtaggatagtaactcctgacctttgacttgttcccaccctgttcaggtcaacatctgaaagcagtgcttcatttccacgatccccagggcagccatcatctttaaggtcagatgatggcctcgggcccccactgccacccccagaagaggagaggcacccaggactatccaatttggccacgccccacagactggctattgagaccaccatgaatgagatccgctggttgttggaagatgagatggtgggggcactccgaagagggggcatcccacagagtcctgccctgcaccgcgcagctgcccatatccatagttctcctggacgctccacctgccttcgccaaactctgccactgagttttgtatttgggccagagcgttccctcacacaattcaaggaggagttccgccgcctccatctccctggccatgttcttcttgaagaccctgacagtggcttcttctttgtggcagctggccaacagccaggtgggtcccatggggagccttcttcagcggcctgggcttggcacagtcatgaggacagggctgaaggcatcgaaggggagaccctgacagccagcccccaagcacctgggtccccagaggattctgagggtgtccccctcatcagcctgccccgcgtgccacagggagggagtcagcctgggcccagccggggattaagtctcatgtccagtcagggcagtgtggactcagaccacctaggttatgatggtggcagcagtggctcagacagtgagggtcccaatgacacccttggtgagaaggcccccttcacattgcggactccacctgggccagcacctccacagccttcactctcaggcctccctgggccctgcctgcctgacttctggctcattgtccgggtcctgcaggaccgtgtggaagtgtatgcacatgcacggagcctgattcgggaggatggggggccgggcactgagtgtcgccacctgcagcagctcctggtgaggcgagttggggagatctgcagggaggtcaaccagcgactgcttcttcaagaccttcatgacagccacgtgtgtaactctcttctggtggccgagagtgaagaagatctgtggcgcagtgagactcccttccactcccgtcagcgggcaccactgcccagtgatgattatgctgctgatgagagctgtgcgccccgtgggtacctggcagccacaatgcagtttgtccctggccatttctcctgtgacgttgtgtggggaactgtgatccgagtccattcacgcctcaaaatggggcccagcatgggggtctctcgggccatccaggccctgcgctctgtgctcaatgccttctctgtggtgaaccggaaaaacatgtttgtttaccaggagcgagcaacaaaggctgtgtactatcttcggctcctagagacatcctgcagtgaccggccatggaaaggggatgcgctgcccccttccctcgctctgtcccgaagccaagagcccatctactctgaggaagcctcgggtcctcgttctcccttagacatggtctctagccgcagttcagatgctgctcgtcctgtgggccaagtggacagacatatccagctgctggtccatggtgttgggcaggcaggtcctgagatcacggatgagctcgtgcgagttctatgtcggcgcctggatgaggccacgctggacgtcatcacagttatgcttgttcggaactgcaagctgacaccagctgatgtggagttcatccagccccctggaagtctcccctcagaggtgctgcatctggccctacccacctcctgcaggccctggcttccagccctggcatggtacctacggcagaacttgctcatcttcctgcactctcccaagtacacagatagcaacagccggaaccacttccaacatccactcccaccacagggtggcctccctgacttggacatctacttgtataacaagcctggtggacagggcactgggggcaaaggggttgcctgcatcactctagcctttgtggatgaaggaggggcccccttgtcactggcgttgtggcccccctcctctccggggcccccagacccactgcgagaggaggaatttgagcaactgacccaggtcatccgctgcccggttgttgtggacagttcttcagctcagaatggggccccacggcttcgattggatgtgtgggaaaaggggaacattagtattgtgcagctggaggagaaactccgaggagcagctcgccaggccctggccgatgccatcatcgagcttcagctgctgccagcttcactatgtacagaggacacacccacaggaagtctcaggaacggatcgttggaaactaagagctctgcaggccgagctagcacctttccccctgcccctgtccctggggagcctgtgactccacccagcaaagcgggccggcgtagcttctgggatatgctgagtaaaacagantgtggggatttgggttcccccaaaacaactgatgacattgtcctggatcggccagaagacactcggggccggaggcgtcacaaaaccgagagtgttcggactcctggtggagctgagcgggcgccaggctcagattctggagcccagagacaaaagcgccggacaacacagctagaagagggtgaggtggggacccttcatcctgtgtttgcccgtgttgctcagcgctggatggagtttatggttcagattggttgtgcctcagtgtccagaagctctgcccacatggtgtcccggttcctccttccatccatcctgtctgagttcaccgcactggtcacctcaatggctggagacaccagtgtccgcatctttgagcagcatttgggttcagagccagagatcttcggcccttgttcccctgggcaactgggcccctctccccgccctgcagctgagcggcatctgctgcttctgggaaggaacttcttgcagtggaggagaccaacacagcaggctgccaaagccatgcagcgcttcgagccaggaggtgatgggagctcagggcgaaatgctccccggcagaggctcttgctactagaggttgtggacaagaagctacagctgctgacctacaactgggctccagacctgggggcagcattgggccgagcgctggttcgcctggtgcagtggcagaatgcacgagcccatctcatcttctgcctactcagccagaagcttggcctcttccatcattatggccagttggacttccccgtgcgagatgaaaaggagccaaacccattcctgctgccgaccatggaagtggagaccctcatccggagtgcaagtcccccgctgagccgtgagcagggccgactgagtgggtcctctcgtggtgggggtcctcttcccctggacacattcccctttgacgaggccctaagggatatcacggctgcccgccccagctccgtacttggtcctgtgcccagacctcctgatcctgtcacctaccatggacaacagttcctagagatcaagatggcagagcgcagagagctggagcgccagatgaagatggaaaacctgtttgtaacctggcagcagcgttctaccccagccaccatgcccatcagtgctggagagctggagaccctgaagcagtcatcccgcctggtgcattactgtgcaacagccatgctcttcgacccagctgcctggctgcatgggcccccagagacctctggaccccctgacgggcagcggcgccatcgccctgagtcagggtctgggagccgagaggcccccacaagctgtgaatccttggatgtgtcgcccccgggagcccgtgaggagccttggctgaaggagctgagcttggctttcctgcagcaatatgtgcagtatctgcagagcataggttttgtgctggtaccactgcggcccccctcacccgcccgcagcaccagccggccacgggccatggctatccttggaacagagggtcgaggctccttctcctgccctaaaaccaagactgatgggagccccaagagcactagctctccggtaaccacctaccacctgcagcgggcactgcctgggggcatcatcctcatggaactggcattccagggctgttacttctgtgtcaaacagtttgccctggaatgttcccgaatcccaatggggcaggctgtcaactcacagctgtccatgctgttcacagaggagtgtgacaaggtgcgggacctgatgcacgtgcactcgttcagctatgacttccatctgcgcctcgtgcatcagcacgtgctaggtgcccatctggtgctgcggcacggctaccacctcaccacctttctgcgacacttcctggcccaccaccctgacggaccccactttggccgcaatcacatttaccaagggacattggagctccccacaccactcattgctgcccaccagctatacaactacgtggctgatcacgccagctcttaccacatgaagccattgcgaatggcccggccagggggcccagaacacaacgagtatgccctggtgtcggcatggcacagttctggctcctacctggactctgagggacttcgacaccaggatgactttgatgtgtctctgcttgtctgtcactgtgctgcaccctttgaggagcaaggagaggctgagcggcacgttctgcggctacagttcttcgtggtgctcaccagccagcgagagctcttccccaggctcactgctgacatgcgccgcttccggaagccacccagactgccccctgagccagaggctcctgggagttcagctggcagccctggggaggcctcagggcttattctagcgcctggaccggctcctctgttcccaccactggctgcagaggtgggcatggcacgagcacggctggctcagctggtgcggctggctggagggcactgccgtcgggacaccctttggaagcgcctcttcttgctggagccaccggggcctgatcgactgcggctaggggggcgcctggccctggcagagctggaggaactcctagaagcagtccatgccaaatccattggggacatcgacccccagctggactgcttcctatccatgacggtctcctggtaccagagcctgatcaaagttctcctaagccgcttcccccagagctgtcgccatttccaaagcccagacttgggaactcagtacctggttgtgctgaatcagaagttcactgactgctttgtgctagtgtttctggactcccacttaggaaagacgtctctgacagtggttttccgagagcccttcccagtacagccccaggacagcgagagcccccctgcccaactggtctccacctaccaccacctggagtctgtcatcaacacagcctgtttcaccctctggacccgcctcctctgagggagtggactggaccactgaatgtcactgttccttgaatcatgggcctaccagattgcctgccagaggcaggactgaccagcccttctgggccccagggcaagccagacactgagtgacaccaaaggctttgtaactatgtcttgagggtctgctgccccagcctggcagcaggaaccgccctccccaaacacccacagccactgacccatccaggactccagagagtcaggtcaaccccgaggaccccttgggcccttctggggtactcctttcggcccccctggtagagtctcgggagttcacacagggtggcaaacaccccctagagctcctctgcctgaatcctgccccctagcctttgaccactgtcagccacctgtgtcccttgagccttcgggtcttcacttcccacttggacatcactgctggacattcccatcgagatgacacctgggttccaatcccagctctgcctttgaagcacttgcggccaccgtcaagtccctttgctctcggaccctgggtttctcatcctttaatgaggtgggttcagaagctctcccatcttcacagcaaccctggcactggcttctcaatgggagggaagcagcagagaaactgaagtgttagacactatgtgtcccaccaccccattacagagacatatgacaatgttcagcaggtcatctttaatgcagaggaggagatgggatgtcactcgctgtctggaggcacgtgggtggtgtgcgggccctcactggccagcctctgggtggccccgcctatcccagtatgaacgtagccaactcaagccctctactgtgtctcctgcagggagagggaggcctcggcacctcagcccacaaggagaaaacagcccctgtccgggtccctccagagctcccttccccagggccacgcctcacctcgaggctgatactcacagcccacgaagcctttgtagccttcatcttccagcagttgaaacagataggggaaattcagctctccggggctgctgggctcccctcggcctgggacctgtgccacctgcacatgccctggggacagatgtggacaaatgtggggtccaggctcc

SEQ ID NO: 287590 - DNA, 5475 bp, Homo sapiens
  misc_feature (52)..(52): n is a, c, g, or t
  misc_feature (75)..(75): n is a, c, g, or t
  misc_feature (1430)..(1430): n is a, c, g, or t
ttattgaacatgttataaaagaggtttagtcaaaaagaccaaagcccatgtnatcatcagactcctcggattctnctttctttgcttccactttcttctcctcagctgattatgctgctgatgagagctgtgcgccccgtgggtacctggcagccacaatgcagtttgtccctggccatttctcctgtgacgttgtgtggggaactgtgatccgagtccattcacgcctcaaaatggggcccagcatgggggtctctcgggccatccaggccctgcgctctgtgctcaatgccttctctgtggtgaaccggaaaaacatgtttgtttaccaggagcgagcaacaaaggctgtgtactatcttcggctcctagagacatcctgcagtgaccggccatggaaaggggatgcgctgcccccttccctcgctctgtcccgaagccaagagcccatctactctgaggaagcctcgggtcctcgttctcccttagacatggtctctagccgcagttcagatgctgctcgtcctgtgggccaagtggacagacatatccagctgctggtccatggtgttgggcaggcaggtcctgagatcacggatgagctcgtgcgagttctatgtcggcgcctggatgaggccacgctggacgtcatcacagttatgcttgttcggaactgcaagctgacaccagctgatgtggagttcatccagccccctggaagtctcccctcagaggtgctgcatctggccctacccacctcctgcaggccctggcttccagccctggcatggtacctacggcagaacttgctcatcttcctgcactctcccaagtacacagatagcaacagccggaaccacttccaacatccactcccaccacagggtggcctccctgacttggacatctacttgtataacaagcctggtggacagggcactgggggcaaaggggttgcctgcatcactctagcctttgtggatgaaggaggggcccccttgtcactggcgttgtggcccccctcctctccggggcccccagacccactgcgagaggaggaatttgagcaactgacccaggtcatccgctgcccggttgttgtggacagttcttcagctcagaatggggccccacggcttcgattggatgtgtgggaaaaggggaacattagtattgtgcagctggaggagaaactccgaggagcagctcgccaggccctggccgatgccatcatcgagcttcagctgctgccagcttcactatgtacagaggacacacccacaggaagtctcaggaacggatcgttggaaactaagagctctgcaggccgagctagcacctttccccctgcccctgtccctggggagcctgtgactccacccagcaaagcgggccggcgtagcttctgggatatgctgagtaaaacagantgtggggatttgggttcccccaaaacaactgatgacattgtcctggatcggccagaagacactcggggccggaggcgtcacaaaaccgagagtgttcggactcctggtggagctgagcgggcgccaggctcagattctggagcccagagacaaaagcgccggacaacacagctagaagagggtgaggtggggacccttcatcctgtgtttgcccgtgttgctcagcgctggatggagtttatggttcagattggttgtgcctcagtgtccagaagctctgcccacatggtgtcccggttcctccttccatccatcctgtctgagttcaccgcactggtcacctcaatggctggagacaccagtgtccgcatctttgagcagcatttgggttcagagccagagatcttcggcccttgttcccctgggcaactgggcccctctccccgccctgcagctgagcggcatctgctgcttctgggaaggaacttcttgcagtggaggagaccaacacagcaggctgccaaagccatgcagcgcttcgagccaggaggtgatgggagctcagggcgaaatgctccccggcagaggctcttgctactagaggttgtggacaagaagctacagctgctgacctacaactgggctccagacctgggggcagcattgggccgagcgctggttcgcctggtgcagtggcagaatgcacgagcccatctcatcttctgcctactcagccagaagcttggcctcttccatcattatggccagttggacttccccgtgcgagatgaaaaggagccaaacccattcctgctgccgaccatggaagtggagaccctcatccggagtgcaagtcccccgctgagccgtgagcagggccgactgagtgggtcctctcgtggtgggggtcctcttcccctggacacattcccctttgacgaggccctaagggatatcacggctgcccgccccagctccgtacttggtcctgtgcccagacctcctgatcctgtcacctaccatggacaacagttcctagagatcaagatggcagagcgcagagagctggagcgccagatgaagatggaaaacctgtttgtaacctggcagcagcgttctaccccagccaccatgcccatcagtgctggagagctggagaccctgaagcagtcatcccgcctggtgcattactgtgcaacagccatgctcttcgacccagctgcctggctgcatgggcccccagagacctctggaccccctgacgggcagcggcgccatcgccctgagtcagggtctgggagccgagaggcccccacaagctgtgaatccttggatgtgtcgcccccgggagcccgtgaggagccttggctgaaggagctgagcttggctttcctgcagcaatatgtgcagtatctgcagagcataggttttgtgctggtaccactgcggcccccctcacccgcccgcagcaccagccggccacgggccatggctatccttggaacagagggtcgaggctccttctcctgccctaaaaccaagactgatgggagccccaagagcactagctctccggtaaccacctaccacctgcagcgggcactgcctgggggcatcatcctcatggaactggcattccagggctgttacttctgtgtcaaacagtttgccctggaatgttcccgaatcccaatggggcaggctgtcaactcacagctgtccatgctgttcacagaggagtgtgacaaggtgcgggacctgatgcacgtgcactcgttcagctatgacttccatctgcgcctcgtgcatcagcacgtgctaggtgcccatctggtgctgcggcacggctaccacctcaccacctttctgcgacacttcctggcccaccaccctgacggaccccactttggccgcaatcacatttaccaagggacattggagctccccacaccactcattgctgcccaccagctatacaactacgtggctgatcacgccagctcttaccacatgaagccattgcgaatggcccggccagggggcccagaacacaacgagtatgccctggtgtcggcatggcacagttctggctcctacctggactctgagggacttcgacaccaggatgactttgatgtgtctctgcttgtctgtcactgtgctgcaccctttgaggagcaaggagaggctgagcggcacgttctgcggctacagttcttcgtggtgctcaccagccagcgagagctcttccccaggctcactgctgacatgcgccgcttccggaagccacccagactgccccctgagccagaggctcctgggagttcagctggcagccctggggaggcctcagggcttattctagcgcctggaccggctcctctgttcccaccactggctgcagaggtgggcatggcacgagcacggctggctcagctggtgcggctggctggagggcactgccgtcgggacaccctttggaagcgcctcttcttgctggagccaccggggcctgatcgactgcggctaggggggcgcctggccctggcagagctggaggaactcctagaagcagtccatgccaaatccattggggacatcgacccccagctggactgcttcctatccatgacggtctcctggtaccagagcctgatcaaagttctcctaagccgcttcccccagagctgtcgccatttccaaagcccagacttgggaactcagtacctggttgtgctgaatcagaagttcactgactgctttgtgctagtgtttctggactcccacttaggaaagacgtctctgacagtggttttccgagagcccttcccagtacagccccaggacagcgagagcccccctgcccaactggtctccacctaccaccacctggagtctgtcatcaacacagcctgtttcaccctctggacccgcctcctctgagggagtggactggaccactgaatgtcactgttccttgaatcatgggcctaccagattgcctgccagaggcaggactgaccagcccttctgggccccagggcaagccagacactgagtgacaccaaaggctttgtaactatgtcttgagggtctgctgccccagcctggcagcaggaaccgccctccccaaacacccacagccactgacccatccaggactccagagagtcaggtcaaccccgaggaccccttgggcccttctggggtactcctttcggcccccctggtagagtctcgggagttcacacagggtggcaaacaccccctagagctcctctgcctgaatcctgccccctagcctttgaccactgtcagccacctgtgtcccttgagccttcgggtcttcacttcccacttggacatcactgctggacattcccatcgagatgacacctgggttccaatcccagctctgcctttgaagcacttgcggccaccgtcaagtccctttgctctcggaccctgggtttctcatcctttaatgaggtgggttcagaagctctcccatcttcacagcaaccctggcactggcttctcaatgggagggaagcagcagagaaactgaagtgttagacactatgtgtcccaccaccccattacagagacatatgacaatgttcagcaggtcatctttaatgcagaggaggagatgggatgtcactcgctgtctggaggcacgtgggtggtgtgcgggccctcactggccagcctctgggtggccccgcctatcccagtatgaacgtagccaactcaagccctctactgtgtctcctgcagggagagggaggcctcggcacctcagcccacaaggagaaaacagcccctgtccgggtccctccagagctcccttccccagggccacgcctcacctcgaggctgatactcacagcccacgaagcctttgtagccttcatcttccagcagttgaaacagataggggaaattcagctctccggggctgctgggctcccctcggcctgggacctgtgccacctgcacatgccctggggacagatgtggacaaatgtggggtccaggctcc

SEQ ID NO: 287591 - DNA, 3498 bp, Homo sapiens
gcggttcagaggaccccacctgcttaatgtccctgcagaggctctgtactaagggggttgtgcgcaagaagctacagctgctgacctacaactgggctccagacctgggggcagcattgggccgagcgctggttcgcctggtgcagtggcagaatgcacgagcccatctcatcttctgcctactcagccagaagcttggcctcttccatcattatggccagttggacttccccgtgcgagatgaaaaggagccaaacccattcctgctgccgaccatggaagtggagaccctcatccggagtgcaagtcccccgctgagccgtgagcagggccgactgagtgggtcctctcgtggtgggggtcctcttcccctggacacattcccctttgacgaggccctaagggatatcacggctgcccgccccagctccgtacttggtcctgtgcccagacctcctgatcctgtcacctaccatggacaacagttcctagagatcaagatggcagagcgcagagagctggagcgccagatgaagatggaaaacctgtttgtaacctggcagcagcgttctaccccagccaccatgcccatcagtgctggagagctggagaccctgaagcagtcatcccgcctggtgcattactgtgcaacagccatgctcttcgacccagctgcctggctgcatgggcccccagagacctctggaccccctgacgggcagcggcgccatcgccctgagtcagggtctgggagccgagaggcccccacaagctgtgaatccttggatgtgtcgcccccgggagcccgtgaggagccttggctgaaggagctgagcttggctttcctgcagcaatatgtgcagtatctgcagagcataggttttgtgctggtaccactgcggcccccctcacccgcccgcagcaccagccggccacgggccatggctatccttggaacagagggtcgaggctccttctcctgccctaaaaccaagactgatgggagccccaagagcactagctctccggtaaccacctaccacctgcagcgggcactgcctgggggcatcatcctcatggaactggcattccagggctgttacttctgtgtcaaacagtttgccctggaatgttcccgaatcccaatggggcaggctgtcaactcacagctgtccatgctgttcacagaggagtgtgacaaggtgcgggacctgatgcacgtgcactcgttcagctatgacttccatctgcgcctcgtgcatcagcacgtgctaggtgcccatctggtgctgcggcacggctaccacctcaccacctttctgcgacacttcctggcccaccaccctgacggaccccactttggccgcaatcacatttaccaagggacattggagctccccacaccactcattgctgcccaccagctatacaactacgtggctgatcacgccagctcttaccacatgaagccattgcgaatggcccggccagggggcccagaacacaacgagtatgccctggtgtcggcatggcacagttctggctcctacctggactctgagggacttcgacaccaggatgactttgatgtgtctctgcttgtctgtcactgtgctgcaccctttgaggagcaaggagaggctgagcggcacgttctgcggctacagttcttcgtggtgctcaccagccagcgagagctcttccccaggctcactgctgacatgcgccgcttccggaagccacccagactgccccctgagccagaggctcctgggagttcagctggcagccctggggaggcctcagggcttattctagcgcctggaccggctcctctgttcccaccactggctgcagaggtgggcatggcacgagcacggctggctcagctggtgcggctggctggagggcactgccgtcgggacaccctttggaagcgcctcttcttgctggagccaccggggcctgatcgactgcggctaggggggcgcctggccctggcagagctggaggaactcctagaagcagtccatgccaaatccattggggacatcgacccccagctggactgcttcctatccatgacggtctcctggtaccagagcctgatcaaagttctcctaagccgcttcccccagagctgtcgccatttccaaagcccagacttgggaactcagtacctggttgtgctgaatcagaagttcactgactgctttgtgctagtgtttctggactcccacttaggaaagacgtctctgacagtggttttccgagagcccttcccagtacagccccaggacagcgagagcccccctgcccaactggtctccacctaccaccacctggagtctgtcatcaacacagcctgtttcaccctctggacccgcctcctctgagggagtggactggaccactgaatgtcactgttccttgaatcatgggcctaccagattgcctgccagaggcaggactgaccagcccttctgggccccagggcaagccagacactgagtgacaccaaaggctttgtaactatgtcttgagggtctgctgccccagcctggcagcaggaaccgccctccccaaacacccacagccactgacccatccaggactccagagagtcaggtcaaccccgaggaccccttgggcccttctggggtactcctttcggcccccctggtagagtctcgggagttcacacagggtggcaaacaccccctagagctcctctgcctgaatcctgccccctagcctttgaccactgtcagccacctgtgtcccttgagccttcgggtcttcacttcccacttggacatcactgctggacattcccatcgagatgacacctgggttccaatcccagctctgcctttgaagcacttgcggccaccgtcaagtccctttgctctcggaccctgggtttctcatcctttaatgaggtgggttcagaagctctcccatcttcacagcaaccctggcactggcttctcaatgggagggaagcagcagagaaactgaagtgttagacactatgtgtcccaccaccccattacagagacatatgacaatgttcagcaggtcatctttaatgcagaggaggagatgggatgtcactcgctgtctggaggcacgtgggtggtgtgcgggccctcactggccagcctctgggtggccccgcctatcccagtatgaacgtagccaactcaagccctctactgtgtctcctgcagggagagggaggcctcggcacctcagcccacaaggagaaaacagcccctgtccgggtccctccagagctcccttccccagggccacgcctcacctcgaggctgatactcacagcccacgaagcctttgtagccttcatcttccagcagttgaaacagataggggaaattcagctctccggggctgctgggctcccctcggcctgggacctgtgccacctgcacatgccctggggacagatgtggacaaatgtggggtccaggctcc

SEQ ID NO: 287592 - DNA, 1456 bp, Homo sapiens
cccaggttgtgctgggtcagtggctgtgggtgtttggggagggcggtctcctggtaccagagcctgatcaaagttctcctaagccgcttcccccagagctgtcgccatttccaaagcccagacttgggaactcagtacctggttgtgctgaatcagaagttcactgactgctttgtgctagtgtttctggactcccacttaggaaagacgtctctgacagtggttttccgagagcccttcccagtacagccccaggacagcgagagcccccctgcccaactggtctccacctaccaccacctggagtctgtcatcaacacagcctgtttcaccctctggacccgcctcctctgagggagtggactggaccactgaatgtcactgttccttgaatcatgggcctaccagattgcctgccagaggcaggactgaccagcccttctgggccccagggcaagccagacactgagtgacaccaaaggctttgtaactatgtcttgagggtctgctgccccagcctggcagcaggaaccgccctccccaaacacccacagccactgacccatccaggactccagagagtcaggtcaaccccgaggaccccttgggcccttctggggtactcctttcggcccccctggtagagtctcgggagttcacacagggtggcaaacaccccctagagctcctctgcctgaatcctgccccctagcctttgaccactgtcagccacctgtgtcccttgagccttcgggtcttcacttcccacttggacatcactgctggacattcccatcgagatgacacctgggttccaatcccagctctgcctttgaagcacttgcggccaccgtcaagtccctttgctctcggaccctgggtttctcatcctttaatgaggtgggttcagaagctctcccatcttcacagcaaccctggcactggcttctcaatgggagggaagcagcagagaaactgaagtgttagacactatgtgtcccaccaccccattacagagacatatgacaatgttcagcaggtcatctttaatgcagaggaggagatgggatgtcactcgctgtctggaggcacgtgggtggtgtgcgggccctcactggccagcctctgggtggccccgcctatcccagtatgaacgtagccaactcaagccctctactgtgtctcctgcagggagagggaggcctcggcacctcagcccacaaggagaaaacagcccctgtccgggtccctccagagctcccttccccagggccacgcctcacctcgaggctgatactcacagcccacgaagcctttgtagccttcatcttccagcagttgaaacagataggggaaattcagctctccggggctgctgggctcccctcggcctgggacctgtgccacctgcacatgccctggggacagatgtggacaaatgtggggtccaggctcc

SEQ ID NO: 287593 - DNA, 7028 bp, Homo sapiens
  misc_feature (924)..(924): n is a, c, g, or t
  misc_feature (940)..(940): n is a, c, g, or t
  misc_feature (3485)..(3485): n is a, c, g, or t
aggcagctaaccactgtgccctgctgcaggagcatgcacagcggtgctatgtccgtgggctattccgcagcttgcagcaagcacagagtgtgacctcccaggatttgctgacagcggtagatgcctgtgaggagctactacaagaaatagacatcaccccatttctccttgcattgtgtggccacacttggggtttgcctcatgcacccccaagtcctggtcctctcagccctgggcccttcagcagcagcatggaggagggtgctgaacctcgggaacgagctatcctagcttctgaatccagcatagagaccgaggacctaagcgagcctgagtttcagagcacccgtgtccctggcattccagaccctgggccagagatctctctgacagatgtctgccagctcagaggagaggcccatggtgcccttcatagcgtcatccaggagaagttcctagagatcagtcgtctccacttccgcacagtgccttccaatccccactacttcttctattgccctccatccagcaggcgagaagatgaggggcctcgggacacagtagacagaaaaatcagtgacctggagttttcagaggctgagcttatgggagaagaaggagacacatctgcctgctgtgtggtcactgagagtgacccagagctagaggtagaataccgggagagccgtgaatcagacctggggcctgctgggctagactctgcctcgctgtcagacgtagacactgtgaatcctgatgaagactccttcagtatcttggggggcgactcacccactgggcctgagagcttccttcatgacctgccaccgctcttcctgcacctcacgtgctccgtgcggctacgtgggcagcacagctcagtacctgtgtgcagcctgcctacctgcctggtttccagtctgnagggccccccagttgnaggccgagttcccttgagggacctcagtgtgactctggatgtcttcatgctgactttgcccctggaagtggagctccccacggcctcggaccctcagcaccaccggtcaacatctgaaagcagtgcttcatttccacgatccccagggcagccatcatctttaaggtcagatgatggcctcgggcccccactgccacccccagaagaggagaggcacccaggactatccaatttggccacgccccacagactggctattgagaccaccatgaatgagatccgctggttgttggaagatgagatggtgggggcactccgaagagggggcatcccacagagtcctgccctgcaccgcgcagctgcccatatccatagttctcctggacgctccacctgccttcgccaaactctgccactgagttttgtatttgggccagagcgttccctcacacaattcaaggaggagttccgccgcctccatctccctggccatgttcttcttgaagaccctgacagtggcttcttctttgtggcagctggccaacagccaggtgggtcccatggggagccttcttcagcggcctgggcttggcacagtcatgaggacagggctgaaggcatcgaaggggagaccctgacagccagcccccaagcacctgggtccccagaggattctgagggtgtccccctcatcagcctgccccgcgtgccacagggagggagtcagcctgggcccagccggggattaagtctcatgtccagtcagggcagtgtggactcagaccacctaggttatgatggtggcagcagtggctcagacagtgagggtcccaatgacacccttggtgagaaggcccccttcacattgcggactccacctgggccagcacctccacagccttcactctcaggcctccctgggccctgcctgcctgacttctggctcattgtccgggtcctgcaggaccgtgtggaagtgtatgcacatgcacggagcctgattcgggaggatggggggccgggcactgagtgtcgccacctgcagcagctcctggtgaggcgagttggggagatctgcagggaggtcaaccagcgactgcttcttcaagaccttcatgacagccacgtgtgtaactctcttctggtggccgagagtgaagaagatctgtggcgcagtgagactcccttccactcccgtcagcgggcaccactgcccagtgatgattatgctgctgatgagagctgtgcgccccgtgggtacctggcagccacaatgcagtttgtccctggccatttctcctgtgacgttgtgtggggaactgtgatccgagtccattcacgcctcaaaatggggcccagcatgggggtctctcgggccatccaggccctgcgctctgtgctcaatgccttctctgtggtgaaccggaaaaacatgtttgtttaccaggagcgagcaacaaaggctgtgtactatcttcggctcctagagacatcctgcagtgaccggccatggaaaggggatgcgctgcccccttccctcgctctgtcccgaagccaagagcccatctactctgaggaagcctcgggtcctcgttctcccttagacatggtctctagccgcagttcagatgctgctcgtcctgtgggccaagtggacagacatatccagctgctggtccatggtgttgggcaggcaggtcctgagatcacggatgagctcgtgcgagttctatgtcggcgcctggatgaggccacgctggacgtcatcacagttatgcttgttcggaactgcaagctgacaccagctgatgtggagttcatccagccccctggaagtctcccctcagaggtgctgcatctggccctacccacctcctgcaggccctggcttccagccctggcatggtacctacggcagaacttgctcatcttcctgcactctcccaagtacacagatagcaacagccggaaccacttccaacatccactcccaccacagggtggcctccctgacttggacatctacttgtataacaagcctggtggacagggcactgggggcaaaggggttgcctgcatcactctagcctttgtggatgaaggaggggcccccttgtcactggcgttgtggcccccctcctctccggggcccccagacccactgcgagaggaggaatttgagcaactgacccaggtcatccgctgcccggttgttgtggacagttcttcagctcagaatggggccccacggcttcgattggatgtgtgggaaaaggggaacattagtattgtgcagctggaggagaaactccgaggagcagctcgccaggccctggccgatgccatcatcgagcttcagctgctgccagcttcactatgtacagaggacacacccacaggaagtctcaggaacggatcgttggaaactaagagctctgcaggccgagctagcacctttccccctgcccctgtccctggggagcctgtgactccacccagcaaagcgggccggcgtagcttctgggatatgctgagtaaaacagantgtggggatttgggttcccccaaaacaactgatgacattgtcctggatcggccagaagacactcggggccggaggcgtcacaaaaccgagagtgttcggactcctggtggagctgagcgggcgccaggctcagattctggagcccagagacaaaagcgccggacaacacagctagaagagggtgaggtggggacccttcatcctgtgtttgcccgtgttgctcagcgctggatggagtttatggttcagattggttgtgcctcagtgtccagaagctctgcccacatggtgtcccggttcctccttccatccatcctgtctgagttcaccgcactggtcacctcaatggctggagacaccagtgtccgcatctttgagcagcatttgggttcagagccagagatcttcggcccttgttcccctgggcaactgggcccctctccccgccctgcagctgagcggcatctgctgcttctgggaaggaacttcttgcagtggaggagaccaacacagcaggctgccaaagccatgcagcgcttcgagccaggaggtgatgggagctcagggcgaaatgctccccggcagaggctcttgctactagaggttgtggacaagaagctacagctgctgacctacaactgggctccagacctgggggcagcattgggccgagcgctggttcgcctggtgcagtggcagaatgcacgagcccatctcatcttctgcctactcagccagaagcttggcctcttccatcattatggccagttggacttccccgtgcgagatgaaaaggagccaaacccattcctgctgccgaccatggaagtggagaccctcatccggagtgcaagtcccccgctgagccgtgagcagggccgactgagtgggtcctctcgtggtgggggtcctcttcccctggacacattcccctttgacgaggccctaagggatatcacggctgcccgccccagctccgtacttggtcctgtgcccagacctcctgatcctgtcacctaccatggacaacagttcctagagatcaagatggcagagcgcagagagctggagcgccagatgaagatggaaaacctgtttgtaacctggcagcagcgttctaccccagccaccatgcccatcagtgctggagagctggagaccctgaagcagtcatcccgcctggtgcattactgtgcaacagccatgctcttcgacccagctgcctggctgcatgggcccccagagacctctggaccccctgacgggcagcggcgccatcgccctgagtcagggtctgggagccgagaggcccccacaagctgtgaatccttggatgtgtcgcccccgggagcccgtgaggagccttggctgaaggagctgagcttggctttcctgcagcaatatgtgcagtatctgcagagcataggttttgtgctggtaccactgcggcccccctcacccgcccgcagcaccagccggccacgggccatggctatccttggaacagagggtcgaggctccttctcctgccctaaaaccaagactgatgggagccccaagagcactagctctccggtaaccacctaccacctgcagcgggcactgcctgggggcatcatcctcatggaactggcattccagggctgttacttctgtgtcaaacagtttgccctggaatgttcccgaatcccaatggggcaggctgtcaactcacagctgtccatgctgttcacagaggagtgtgacaaggtgcgggacctgatgcacgtgcactcgttcagctatgacttccatctgcgcctcgtgcatcagcacgtgctaggtgcccatctggtgctgcggcacggctaccacctcaccacctttctgcgacacttcctggcccaccaccctgacggaccccactttggccgcaatcacatttaccaagggacattggagctccccacaccactcattgctgcccaccagctatacaactacgtggctgatcacgccagctcttaccacatgaagccattgcgaatggcccggccagggggcccagaacacaacgagtatgccctggtgtcggcatggcacagttctggctcctacctggactctgagggacttcgacaccaggatgactttgatgtgtctctgcttgtctgtcactgtgctgcaccctttgaggagcaaggagaggctgagcggcacgttctgcggctacagttcttcgtggtgctcaccagccagcgagagctcttccccaggctcactgctgacatgcgccgcttccggaagccacccagactgccccctgagccagaggctcctgggagttcagctggcagccctggggaggcctcagggcttattctagcgcctggaccggctcctctgttcccaccactggctgcagaggtgggcatggcacgagcacggctggctcagctggtgcggctggctggagggcactgccgtcgggacaccctttggaagcgcctcttcttgctggagccaccggggcctgatcgactgcggctaggggggcgcctggccctggcagagctggaggaactcctagaagcagtccatgccaaatccattggggacatcgacccccagctggactgcttcctatccatgacggtctcctggtaccagagcctgatcaaagttctcctaagccgcttcccccagagctgtcgccatttccaaagcccagacttgggaactcagtacctggttgtgctgaatcagaagttcactgactgctttgtgctagtgtttctggactcccacttaggaaagacgcctttgaccactgtcagccacctgtgtcccttgagccttcgggtcttcacttcccacttggacatcactgctggacattcccatcgagatgacacctgggttccaatcccagctctgcctttgaagcacttgcggccaccgtcaagtccctttgctctcggaccctgggtttctcatcctttaatgaggtgggttcagaagctctcccatcttcacagcaaccctggcactggcttctcaatgggagggaagcagcagagaaactgaagtgttagacactatgtgtcccaccaccccattacagagacatatgacaatgttcagcaggtcatctttaatgcagaggaggagatgggatgtcactcgctgtctggaggcacgtgggtggtgtgcgggccctcactggccagcctctgggtggccccgcctatcccagtatgaacgtagccaactcaagccctctactgtgtctcctgcagggagagggaggcctcggcacctcagcccacaaggagaaaacagcccctgtccgggtccctccagagctcccttccccagggccacgcctcacctcgaggctgatactcacagcccacgaagcctttgtagccttcatcttccagcagttgaaacagataggggaaattcagctctccggggctgctgggctcccctcggcctgggacctgtgccacctgcacatgccctggggacagatgtggacaaatgtggggtccaggctcc

SEQ ID NO: 287594 - DNA, 6834 bp, Homo sapiens
  misc_feature (1090)..(1090): n is a, c, g, or t
  misc_feature (1106)..(1106): n is a, c, g, or t
  misc_feature (3651)..(3651): n is a, c, g, or t
aggcagctaaccactgtgccctgctgcaggagcatgcacagcggtgctatgtccgtgggctattccgcagcttgcagcaagcacagagtgtgacctcccaggatttgctgacagcggtagatgcctgtgaggagctactacaagaaatagacatcaccccatttctccttgcattgtgtggccacacttggggtttgcctcatgcacccccaagtcctggtcctctcagccctgggcccttcagcagcagcatggaggagggtgctgaacctcgggaacgagctatcctagcttctgaatccagcatagagaccgaggacctaagcgagcctgagtttcagagcacccgtgtccctggcattccagaccctgggccagagatctctctgacagatgtctgccagctcagaggagaggcccatggtgcccttcatagcgtcatccaggtgggaagcttgggtgagggtagaagaggtgttagagtcctgcctgtgcagagggacaggattctctcctgggcggggggtatgcatgtgtcctgctctagggtagggagtagtatcctgttgaggggtgactgacattctaacctccttctaaaccccacaacaggagaagttcctagagatcagtcgtctccacttccgcacagtgccttccaatccccactacttcttctattgccctccatccagcaggcgagaagatgaggggcctcgggacacagtagacagaaaaatcagtgacctggagttttcagaggctgagcttatgggagaagaaggagacacatctgcctgctgtgtggtcactgagagtgacccagagctagaggtagaataccgggagagccgtgaatcagacctggggcctgctgggctagactctgcctcgctgtcagacgtagacactgtgaatcctgatgaagactccttcagtatcttggggggcgactcacccactgggcctgagagcttccttcatgacctgccaccgctcttcctgcacctcacgtgctccgtgcggctacgtgggcagcacagctcagtacctgtgtgcagcctgcctacctgcctggtttccagtctgnagggccccccagttgnaggccgagttcccttgagggacctcagtgtgactctggatgtcttcatgctgactttgcccctggaagtggagctccccacggcctcggaccctcagcaccaccggtcaacatctgaaagcagtgcttcatttccacgatccccagggcagccatcatctttaaggtcagatgatggcctcgggcccccactgccacccccagaagaggagaggcacccaggactatccaatttggccacgccccacagactggctattgagaccaccatgaatgagatccgctggttgttggaagatgagatggtgggggcactccgaagagggggcatcccacagagtcctgccctgcaccgcgcagctgcccatatccatagttctcctggacgctccacctgccttcgccaaactctgccactgagttttgtatttgggccagagcgttccctcacacaattcaaggaggagttccgccgcctccatctccctggccatgttcttcttgaagaccctgacagtggcttcttctttgtggcagctggccaacagccaggtgggtcccatggggagccttcttcagcggcctgggcttggcacagtcatgaggacagggctgaaggcatcgaaggggagaccctgacagccagcccccaagcacctgggtccccagaggattctgagggtgtccccctcatcagcctgccccgcgtgccacagggagggagtcagcctgggcccagccggggattaagtctcatgtccagtcagggcagtgtggactcagaccacctaggttatgatggtggcagcagtggctcagacagtgagggtcccaatgacacccttggtgagaaggcccccttcacattgcggactccacctgggccagcacctccacagccttcactctcaggcctccctgggccctgcctgcctgacttctggctcattgtccgggtcctgcaggaccgtgtggaagtgtatgcacatgcacggagcctgattcgggaggatggggggccgggcactgagtgtcgccacctgcagcagctcctggtgaggcgagttggggagatctgcagggaggtcaaccagcgactgcttcttcaagaccttcatgacagccacgtgtgtaactctcttctggtggccgagagtgaagaagatctgtggcgcagtgagactcccttccactcccgtcagcgggcaccactgcccagtgatgattatgctgctgatgagagctgtgcgccccgtgggtacctggcagccacaatgcagtttgtccctggccatttctcctgtgacgttgtgtggggaactgtgatccgagtccattcacgcctcaaaatggggcccagcatgggggtctctcgggccatccaggccctgcgctctgtgctcaatgccttctctgtggtgaaccggaaaaacatgtttgtttaccaggagcgagcaacaaaggctgtgtactatcttcggctcctagagacatcctgcagtgaccggccatggaaaggggatgcgctgcccccttccctcgctctgtcccgaagccaagagcccatctactctgaggaagcctcgggtcctcgttctcccttagacatggtctctagccgcagttcagatgctgctcgtcctgtgggccaagtggacagacatatccagctgctggtccatggtgttgggcaggcaggtcctgagatcacggatgagctcgtgcgagttctatgtcggcgcctggatgaggccacgctggacgtcatcacagttatgcttgttcggaactgcaagctgacaccagctgatgtggagttcatccagccccctggaagtctcccctcagaggtgctgcatctggccctacccacctcctgcaggccctggcttccagccctggcatggtacctacggcagaacttgctcatcttcctgcactctcccaagtacacagatagcaacagccggaaccacttccaacatccactcccaccacagggtggcctccctgacttggacatctacttgtataacaagcctggtggacagggcactgggggcaaaggggttgcctgcatcactctagcctttgtggatgaaggaggggcccccttgtcactggcgttgtggcccccctcctctccggggcccccagacccactgcgagaggaggaatttgagcaactgacccaggtcatccgctgcccggttgttgtggacagttcttcagctcagaatggggccccacggcttcgattggatgtgtgggaaaaggggaacattagtattgtgcagctggaggagaaactccgaggagcagctcgccaggccctggccgatgccatcatcgagcttcagctgctgccagcttcactatgtacagaggacacacccacaggaagtctcaggaacggatcgttggaaactaagagctctgcaggccgagctagcacctttccccctgcccctgtccctggggagcctgtgactccacccagcaaagcgggccggcgtagcttctgggatatgctgagtaaaacagantgtggggatttgggttcccccaaaacaactgatgacattgtcctggatcggccagaagacactcggggccggaggcgtcacaaaaccgagagtgttcggactcctggtggagctgagcgggcgccaggctcagattctggagcccagagacaaaagcgccggacaacacagctagaagagggtgaggtggggacccttcatcctgtgtttgcccgtgttgctcagcgctggatggagtttatggttcagattggttgtgcctcagtgtccagaagctctgcccacatggtgtcccggttcctccttccatccatcctgtctgagttcaccgcactggtcacctcaatggctggagacaccagtgtccgcatctttgagcagcatttgggttcagagccagagatcttcggcccttgttcccctgggcaactgggcccctctccccgccctgcagctgagcggcatctgctgcttctgggaaggaacttcttgcagtggaggagaccaacacagcaggctgccaaagccatgcagcgcttcgagccaggaggtgatgggagctcagggcgaaatgctccccggcagaggctcttgctactagaggttgtggacaagaagctacagctgctgacctacaactgggctccagacctgggggcagcattgggccgagcgctggttcgcctggtgcagtggcagaatgcacgagcccatctcatcttctgcctactcagccagaagcttggcctcttccatcattatggccagttggacttccccgtgcgagatgaaaaggagccaaacccattcctgctgccgaccatggaagtggagaccctcatccggagtgcaagtcccccgctgagccgtgagcagggccgactgagtgggtcctctcgtggtgggggtcctcttcccctggacacattcccctttgacgaggccctaagggatatcacggctgcccgccccagctccgtacttggtcctgtgcccagacctcctgatcctgtcacctaccatggacaacagttcctagagatcaagatggcagagcgcagagagctggagcgccagatgaagatggaaaacctgtttgtaacctggcagcagcgttctaccccagccaccatgcccatcagtgctggagagctggagaccctgaagcagtcatcccgcctggtgcattactgtgcaacagccatgctcttcgacccagctgcctggctgcatgggcccccagagacctctggaccccctgacgggcagcggcgccatcgccctgagtcagggtctgggagccgagaggcccccacaagctgtgaatccttggatgtgtcgcccccgggagcccgtgaggagccttggctgaaggagctgagcttggctttcctgcagcaatatgtgcagtatctgcagagcataggttttgtgctggtaccactgcggcccccctcacccgcccgcagcaccagccggccacgggccatggctatccttggaacagagggtcgaggctccttctcctgccctaaaaccaagactgatgggagccccaagagcactagctctccggtaaccacctaccacctgcagcgggcactgcctgggggcatcatcctcatggaactggcattccagggctgttacttctgtgtcaaacagtttgccctggaatgttcccgaatcccaatggggcaggctgtcaactcacagctgtccatgctgttcacagaggagtgtgacaaggtgcgggacctgatgcacgtgcactcgttcagctatgacttccatctgcgcctcgtgcatcagcacgtgctaggtgcccatctggtgctgcggcacggctaccacctcaccacctttctgcgacacttcctggcccaccaccctgacggaccccactttggccgcaatcacatttaccaagggacattggagctccccacaccactcattgctgcccaccagctatacaactacgtggctgatcacgccagctcttaccacatgaagccattgcgaatggcccggccagggggcccagaacacaacgagtatgccctggtgtcggcatggcacagttctggctcctacctggactctgagggacttcgacaccaggatgactttgatgtgtctctgcttgtctgtcactgtgctgcaccctttgaggagcaaggagaggctgagcggcacgttctgcggctacagttcttcgtggtgctcaccagccagcgagagctcttccccaggctcactgctgacatgcgccgcttccggaagccacccagactgccccctgagccagaggctcctgggagttcagctggcagccctggggaggcctcagggcttattctagcgcctggaccggctcctctgttcccaccactggctgcagaggtgggcatggcacgagcacggctggctcagctggtgcggctggctggagggcactgccgtcgggacaccctttggaagcgcctcttcttgctggagccaccggggcctgatcgactgcggctaggggggcgcctggccctggcagagctggaggaactcctagaagcagtccatgccaaatccattggggacatcgacccccagctggactgcttcctatccatgacggtctcctggtaccagagcctgatcaaagttctcctaagccgcttcccccagagctgtcgccatttccaaagcccagacttgggaactcagtacctggttgtgctgaatcagaagttcactgactgctttgtgctagtgtttctggactcccacttaggaaagacgtctctgacagtggttttccgagagcccttcccagtacagccccaggacagcgagagcccccctgcccaactggtctccacctaccaccacctggagtctgtcatcaacacagcctgtttcaccctctggacccgcctcctctgagggagtggactggaccactgaatgtcactgttccttgaatcatgggcctaccagattgcctgccagaggcaggactgaccagcccttctgggccccagggcaagccagacactgagtgacaccaaaggctttgtaactatgtcttgagggtctgctgccccagcctggcagcaggaaccgccctccccaacaccccccagaaacactacatccagagcacaatcaggcccaaaactcctg

SEQ ID NO: 287595 - DNA, 7197 bp, Homo sapiens
  misc_feature (1090)..(1090): n is a, c, g, or t
  misc_feature (1106)..(1106): n is a, c, g, or t
  misc_feature (3651)..(3651): n is a, c, g, or t
aggcagctaaccactgtgccctgctgcaggagcatgcacagcggtgctatgtccgtgggctattccgcagcttgcagcaagcacagagtgtgacctcccaggatttgctgacagcggtagatgcctgtgaggagctactacaagaaatagacatcaccccatttctccttgcattgtgtggccacacttggggtttgcctcatgcacccccaagtcctggtcctctcagccctgggcccttcagcagcagcatggaggagggtgctgaacctcgggaacgagctatcctagcttctgaatccagcatagagaccgaggacctaagcgagcctgagtttcagagcacccgtgtccctggcattccagaccctgggccagagatctctctgacagatgtctgccagctcagaggagaggcccatggtgcccttcatagcgtcatccaggtgggaagcttgggtgagggtagaagaggtgttagagtcctgcctgtgcagagggacaggattctctcctgggcggggggtatgcatgtgtcctgctctagggtagggagtagtatcctgttgaggggtgactgacattctaacctccttctaaaccccacaacaggagaagttcctagagatcagtcgtctccacttccgcacagtgccttccaatccccactacttcttctattgccctccatccagcaggcgagaagatgaggggcctcgggacacagtagacagaaaaatcagtgacctggagttttcagaggctgagcttatgggagaagaaggagacacatctgcctgctgtgtggtcactgagagtgacccagagctagaggtagaataccgggagagccgtgaatcagacctggggcctgctgggctagactctgcctcgctgtcagacgtagacactgtgaatcctgatgaagactccttcagtatcttggggggcgactcacccactgggcctgagagcttccttcatgacctgccaccgctcttcctgcacctcacgtgctccgtgcggctacgtgggcagcacagctcagtacctgtgtgcagcctgcctacctgcctggtttccagtctgnagggccccccagttgnaggccgagttcccttgagggacctcagtgtgactctggatgtcttcatgctgactttgcccctggaagtggagctccccacggcctcggaccctcagcaccaccggtcaacatctgaaagcagtgcttcatttccacgatccccagggcagccatcatctttaaggtcagatgatggcctcgggcccccactgccacccccagaagaggagaggcacccaggactatccaatttggccacgccccacagactggctattgagaccaccatgaatgagatccgctggttgttggaagatgagatggtgggggcactccgaagagggggcatcccacagagtcctgccctgcaccgcgcagctgcccatatccatagttctcctggacgctccacctgccttcgccaaactctgccactgagttttgtatttgggccagagcgttccctcacacaattcaaggaggagttccgccgcctccatctccctggccatgttcttcttgaagaccctgacagtggcttcttctttgtggcagctggccaacagccaggtgggtcccatggggagccttcttcagcggcctgggcttggcacagtcatgaggacagggctgaaggcatcgaaggggagaccctgacagccagcccccaagcacctgggtccccagaggattctgagggtgtccccctcatcagcctgccccgcgtgccacagggagggagtcagcctgggcccagccggggattaagtctcatgtccagtcagggcagtgtggactcagaccacctaggttatgatggtggcagcagtggctcagacagtgagggtcccaatgacacccttggtgagaaggcccccttcacattgcggactccacctgggccagcacctccacagccttcactctcaggcctccctgggccctgcctgcctgacttctggctcattgtccgggtcctgcaggaccgtgtggaagtgtatgcacatgcacggagcctgattcgggaggatggggggccgggcactgagtgtcgccacctgcagcagctcctggtgaggcgagttggggagatctgcagggaggtcaaccagcgactgcttcttcaagaccttcatgacagccacgtgtgtaactctcttctggtggccgagagtgaagaagatctgtggcgcagtgagactcccttccactcccgtcagcgggcaccactgcccagtgatgattatgctgctgatgagagctgtgcgccccgtgggtacctggcagccacaatgcagtttgtccctggccatttctcctgtgacgttgtgtggggaactgtgatccgagtccattcacgcctcaaaatggggcccagcatgggggtctctcgggccatccaggccctgcgctctgtgctcaatgccttctctgtggtgaaccggaaaaacatgtttgtttaccaggagcgagcaacaaaggctgtgtactatcttcggctcctagagacatcctgcagtgaccggccatggaaaggggatgcgctgcccccttccctcgctctgtcccgaagccaagagcccatctactctgaggaagcctcgggtcctcgttctcccttagacatggtctctagccgcagttcagatgctgctcgtcctgtgggccaagtggacagacatatccagctgctggtccatggtgttgggcaggcaggtcctgagatcacggatgagctcgtgcgagttctatgtcggcgcctggatgaggccacgctggacgtcatcacagttatgcttgttcggaactgcaagctgacaccagctgatgtggagttcatccagccccctggaagtctcccctcagaggtgctgcatctggccctacccacctcctgcaggccctggcttccagccctggcatggtacctacggcagaacttgctcatcttcctgcactctcccaagtacacagatagcaacagccggaaccacttccaacatccactcccaccacagggtggcctccctgacttggacatctacttgtataacaagcctggtggacagggcactgggggcaaaggggttgcctgcatcactctagcctttgtggatgaaggaggggcccccttgtcactggcgttgtggcccccctcctctccggggcccccagacccactgcgagaggaggaatttgagcaactgacccaggtcatccgctgcccggttgttgtggacagttcttcagctcagaatggggccccacggcttcgattggatgtgtgggaaaaggggaacattagtattgtgcagctggaggagaaactccgaggagcagctcgccaggccctggccgatgccatcatcgagcttcagctgctgccagcttcactatgtacagaggacacacccacaggaagtctcaggaacggatcgttggaaactaagagctctgcaggccgagctagcacctttccccctgcccctgtccctggggagcctgtgactccacccagcaaagcgggccggcgtagcttctgggatatgctgagtaaaacagantgtggggatttgggttcccccaaaacaactgatgacattgtcctggatcggccagaagacactcggggccggaggcgtcacaaaaccgagagtgttcggactcctggtggagctgagcgggcgccaggctcagattctggagcccagagacaaaagcgccggacaacacagctagaagagggtgaggtggggacccttcatcctgtgtttgcccgtgttgctcagcgctggatggagtttatggttcagattggttgtgcctcagtgtccagaagctctgcccacatggtgtcccggttcctccttccatccatcctgtctgagttcaccgcactggtcacctcaatggctggagacaccagtgtccgcatctttgagcagcatttgggttcagagccagagatcttcggcccttgttcccctgggcaactgggcccctctccccgccctgcagctgagcggcatctgctgcttctgggaaggaacttcttgcagtggaggagaccaacacagcaggctgccaaagccatgcagcgcttcgagccaggaggtgatgggagctcagggcgaaatgctccccggcagaggctcttgctactagaggttgtggacaagaagctacagctgctgacctacaactgggctccagacctgggggcagcattgggccgagcgctggttcgcctggtgcagtggcagaatgcacgagcccatctcatcttctgcctactcagccagaagcttggcctcttccatcattatggccagttggacttccccgtgcgagatgaaaaggagccaaacccattcctgctgccgaccatggaagtggagaccctcatccggagtgcaagtcccccgctgagccgtgagcagggccgactgagtgggtcctctcgtggtgggggtcctcttcccctggacacattcccctttgacgaggccctaagggatatcacggctgcccgccccagctccgtacttggtcctgtgcccagacctcctgatcctgtcacctaccatggacaacagttcctagagatcaagatggcagagcgcagagagctggagcgccagatgaagatggaaaacctgtttgtaacctggcagcagcgttctaccccagccaccatgcccatcagtgctggagagctggagaccctgaagcagtcatcccgcctggtgcattactgtgcaacagccatgctcttcgacccagctgcctggctgcatgggcccccagagacctctggaccccctgacgggcagcggcgccatcgccctgagtcagggtctgggagccgagaggcccccacaagctgtgaatccttggatgtgtcgcccccgggagcccgtgaggagccttggctgaaggagctgagcttggctttcctgcagcaatatgtgcagtatctgcagagcataggttttgtgctggtaccactgcggcccccctcacccgcccgcagcaccagccggccacgggccatggctatccttggaacagagggtcgaggctccttctcctgccctaaaaccaagactgatgggagccccaagagcactagctctccggtaaccacctaccacctgcagcgggcactgcctgggggcatcatcctcatggaactggcattccagggctgttacttctgtgtcaaacagtttgccctggaatgttcccgaatcccaatggggcaggctgtcaactcacagctgtccatgctgttcacagaggagtgtgacaaggtgcgggacctgatgcacgtgcactcgttcagctatgacttccatctgcgcctcgtgcatcagcacgtgctaggtgcccatctggtgctgcggcacggctaccacctcaccacctttctgcgacacttcctggcccaccaccctgacggaccccactttggccgcaatcacatttaccaagggacattggagctccccacaccactcattgctgcccaccagctatacaactacgtggctgatcacgccagctcttaccacatgaagccattgcgaatggcccggccagggggcccagaacacaacgagtatgccctggtgtcggcatggcacagttctggctcctacctggactctgagggacttcgacaccaggatgactttgatgtgtctctgcttgtctgtcactgtgctgcaccctttgaggagcaaggagaggctgagcggcacgttctgcggctacagttcttcgtggtgctcaccagccagcgagagctcttccccaggctcactgctgacatgcgccgcttccggaagccacccagactgccccctgagccagaggctcctgggagttcagctggcagccctggggaggcctcagggcttattctagcgcctggaccggctcctctgttcccaccactggctgcagaggtgggcatggcacgagcacggctggctcagctggtgcggctggctggagggcactgccgtcgggacaccctttggaagcgcctcttcttgctggagccaccggggcctgatcgactgcggctaggggggcgcctggccctggcagagctggaggaactcctagaagcagtccatgccaaatccattggggacatcgacccccagctggactgcttcctatccatgacggtctcctggtaccagagcctgatcaaagttctcctaagccgcttcccccagagctgtcgccatttccaaagcccagacttgggaactcagtacctggttgtgctgaatcagaagttcactgactgctttgtgctagtgtttctggactcccacttaggaaagacgtctctgacagtggttttccgagagcccttcccagtacagccccaggacagcgagagcccccctgcccaactggtctccacctaccaccacctggagtctgtcatcaacacagcctgtttcaccctctggacccgcctcctctgagggagtggactggaccactgaatgtcactgttccttgaatcatgggcctaccagattgcctgccagaggcaggactgaccagcccttctgggccccagggcaagccagacactgagtgacaccaaaggctttgtaaactatgtgtcccaccaccccattacagagacatatgacaatgttcagcaggtcatctttaatgcagaggaggagatgggatgtcactcgctgtctggaggcacgtgggtggtgtgcgggccctcactggccagcctctgggtggccccgcctatcccagtatgaacgtagccaactcaagccctctactgtgtctcctgcagggagagggaggcctcggcacctcagcccacaaggagaaaacagcccctgtccgggtccctccagagctcccttccccagggccacgcctcacctcgaggctgatactcacagcccacgaagcctttgtagccttcatcttccagcagttgaaacagataggggaaattcagctctccggggctgctgggctcccctcggcctgggacctgtgccacctgcacatgccctggggacagatgtggacaaatgtggggtccaggctcc

SEQ ID NO: 287596 - DNA, 6937 bp, Homo sapiens
  misc_feature (1090)..(1090): n is a, c, g, or t
  misc_feature (1106)..(1106): n is a, c, g, or t
  misc_feature (3651)..(3651): n is a, c, g, or t
aggcagctaaccactgtgccctgctgcaggagcatgcacagcggtgctatgtccgtgggctattccgcagcttgcagcaagcacagagtgtgacctcccaggatttgctgacagcggtagatgcctgtgaggagctactacaagaaatagacatcaccccatttctccttgcattgtgtggccacacttggggtttgcctcatgcacccccaagtcctggtcctctcagccctgggcccttcagcagcagcatggaggagggtgctgaacctcgggaacgagctatcctagcttctgaatccagcatagagaccgaggacctaagcgagcctgagtttcagagcacccgtgtccctggcattccagaccctgggccagagatctctctgacagatgtctgccagctcagaggagaggcccatggtgcccttcatagcgtcatccaggtgggaagcttgggtgagggtagaagaggtgttagagtcctgcctgtgcagagggacaggattctctcctgggcggggggtatgcatgtgtcctgctctagggtagggagtagtatcctgttgaggggtgactgacattctaacctccttctaaaccccacaacaggagaagttcctagagatcagtcgtctccacttccgcacagtgccttccaatccccactacttcttctattgccctccatccagcaggcgagaagatgaggggcctcgggacacagtagacagaaaaatcagtgacctggagttttcagaggctgagcttatgggagaagaaggagacacatctgcctgctgtgtggtcactgagagtgacccagagctagaggtagaataccgggagagccgtgaatcagacctggggcctgctgggctagactctgcctcgctgtcagacgtagacactgtgaatcctgatgaagactccttcagtatcttggggggcgactcacccactgggcctgagagcttccttcatgacctgccaccgctcttcctgcacctcacgtgctccgtgcggctacgtgggcagcacagctcagtacctgtgtgcagcctgcctacctgcctggtttccagtctgnagggccccccagttgnaggccgagttcccttgagggacctcagtgtgactctggatgtcttcatgctgactttgcccctggaagtggagctccccacggcctcggaccctcagcaccaccggtcaacatctgaaagcagtgcttcatttccacgatccccagggcagccatcatctttaaggtcagatgatggcctcgggcccccactgccacccccagaagaggagaggcacccaggactatccaatttggccacgccccacagactggctattgagaccaccatgaatgagatccgctggttgttggaagatgagatggtgggggcactccgaagagggggcatcccacagagtcctgccctgcaccgcgcagctgcccatatccatagttctcctggacgctccacctgccttcgccaaactctgccactgagttttgtatttgggccagagcgttccctcacacaattcaaggaggagttccgccgcctccatctccctggccatgttcttcttgaagaccctgacagtggcttcttctttgtggcagctggccaacagccaggtgggtcccatggggagccttcttcagcggcctgggcttggcacagtcatgaggacagggctgaaggcatcgaaggggagaccctgacagccagcccccaagcacctgggtccccagaggattctgagggtgtccccctcatcagcctgccccgcgtgccacagggagggagtcagcctgggcccagccggggattaagtctcatgtccagtcagggcagtgtggactcagaccacctaggttatgatggtggcagcagtggctcagacagtgagggtcccaatgacacccttggtgagaaggcccccttcacattgcggactccacctgggccagcacctccacagccttcactctcaggcctccctgggccctgcctgcctgacttctggctcattgtccgggtcctgcaggaccgtgtggaagtgtatgcacatgcacggagcctgattcgggaggatggggggccgggcactgagtgtcgccacctgcagcagctcctggtgaggcgagttggggagatctgcagggaggtcaaccagcgactgcttcttcaagaccttcatgacagccacgtgtgtaactctcttctggtggccgagagtgaagaagatctgtggcgcagtgagactcccttccactcccgtcagcgggcaccactgcccagtgatgattatgctgctgatgagagctgtgcgccccgtgggtacctggcagccacaatgcagtttgtccctggccatttctcctgtgacgttgtgtggggaactgtgatccgagtccattcacgcctcaaaatggggcccagcatgggggtctctcgggccatccaggccctgcgctctgtgctcaatgccttctctgtggtgaaccggaaaaacatgtttgtttaccaggagcgagcaacaaaggctgtgtactatcttcggctcctagagacatcctgcagtgaccggccatggaaaggggatgcgctgcccccttccctcgctctgtcccgaagccaagagcccatctactctgaggaagcctcgggtcctcgttctcccttagacatggtctctagccgcagttcagatgctgctcgtcctgtgggccaagtggacagacatatccagctgctggtccatggtgttgggcaggcaggtcctgagatcacggatgagctcgtgcgagttctatgtcggcgcctggatgaggccacgctggacgtcatcacagttatgcttgttcggaactgcaagctgacaccagctgatgtggagttcatccagccccctggaagtctcccctcagaggtgctgcatctggccctacccacctcctgcaggccctggcttccagccctggcatggtacctacggcagaacttgctcatcttcctgcactctcccaagtacacagatagcaacagccggaaccacttccaacatccactcccaccacagggtggcctccctgacttggacatctacttgtataacaagcctggtggacagggcactgggggcaaaggggttgcctgcatcactctagcctttgtggatgaaggaggggcccccttgtcactggcgttgtggcccccctcctctccggggcccccagacccactgcgagaggaggaatttgagcaactgacccaggtcatccgctgcccggttgttgtggacagttcttcagctcagaatggggccccacggcttcgattggatgtgtgggaaaaggggaacattagtattgtgcagctggaggagaaactccgaggagcagctcgccaggccctggccgatgccatcatcgagcttcagctgctgccagcttcactatgtacagaggacacacccacaggaagtctcaggaacggatcgttggaaactaagagctctgcaggccgagctagcacctttccccctgcccctgtccctggggagcctgtgactccacccagcaaagcgggccggcgtagcttctgggatatgctgagtaaaacagantgtggggatttgggttcccccaaaacaactgatgacattgtcctggatcggccagaagacactcggggccggaggcgtcacaaaaccgagagtgttcggactcctggtggagctgagcgggcgccaggctcagattctggagcccagagacaaaagcgccggacaacacagctagaagagggtgaggtggggacccttcatcctgtgtttgcccgtgttgctcagcgctggatggagtttatggttcagattggttgtgcctcagtgtccagaagctctgcccacatggtgtcccggttcctccttccatccatcctgtctgagttcaccgcactggtcacctcaatggctggagacaccagtgtccgcatctttgagcagcatttgggttcagagccagagatcttcggcccttgttcccctgggcaactgggcccctctccccgccctgcagctgagcggcatctgctgcttctgggaaggaacttcttgcagtggaggagaccaacacagcaggctgccaaagccatgcagcgcttcgagccaggaggtgatgggagctcagggcgaaatgctccccggcagaggctcttgctactagaggttgtggacaagaagctacagctgctgacctacaactgggctccagacctgggggcagcattgggccgagcgctggttcgcctggtgcagtggcagaatgcacgagcccatctcatcttctgcctactcagccagaagcttggcctcttccatcattatggccagttggacttccccgtgcgagatgaaaaggagccaaacccattcctgctgccgaccatggaagtggagaccctcatccggagtgcaagtcccccgctgagccgtgagcagggccgactgagtgggtcctctcgtggtgggggtcctcttcccctggacacattcccctttgacgaggccctaagggatatcacggctgcccgccccagctccgtacttggtcctgtgcccagacctcctgatcctgtcacctaccatggacaacagttcctagagatcaagatggcagagcgcagagagctggagcgccagatgaagatggaaaacctgtttgtaacctggcagcagcgttctaccccagccaccatgcccatcagtgctggagagctggagaccctgaagcagtcatcccgcctggtgcattactgtgcaacagccatgctcttcgacccagctgcctggctgcatgggcccccagagacctctggaccccctgacgggcagcggcgccatcgccctgagtcagggtctgggagccgagaggcccccacaagctgtgaatccttggatgtgtcgcccccgggagcccgtgaggagccttggctgaaggagctgagcttggctttcctgcagcaatatgtgcagtatctgcagagcataggttttgtgctggtaccactgcggcccccctcacccgcccgcagcaccagccggccacgggccatggctatccttggaacagagggtcgaggctccttctcctgccctaaaaccaagactgatgggagccccaagagcactagctctccggtaaccacctaccacctgcagcgggcactgcctgggggcatcatcctcatggaactggcattccagggctgttacttctgtgtcaaacagtttgccctggaatgttcccgaatcccaatggggcaggctgtcaactcacagctgtccatgctgttcacagaggagtgtgacaaggtgcgggacctgatgcacgtgcactcgttcagctatgacttccatctgcgcctcgtgcatcagcacgtgctaggtgcccatctggtgctgcggcacggctaccacctcaccacctttctgcgacacttcctggcccaccaccctgacggaccccactttggccgcaatcacatttaccaagggacattggagctccccacaccactcattgctgcccaccagctatacaactacgtggctgatcacgccagctcttaccacatgaagccattgcgaatggcccggccagggggcccagaacacaacgagtatgccctggtgtcggcatggcacagttctggctcctacctggactctgagggacttcgacaccaggatgactttgatgtgtctctgcttgtctgtcactgtgctgcaccctttgaggagcaaggagaggctgagcggcacgttctgcggctacagttcttcgtggtgctcaccagccagcgagagctcttccccaggctcactgctgacatgcgccgcttccggaagccacccagactgccccctgagccagaggctcctgggagttcagctggcagccctggggaggcctcagggcttattctagcgcctggaccggctcctctgttcccaccactggctgcagaggtgggcatggcacgagcacggctggctcagctggtgcggctggctggagggcactgccgtcgggacaccctttggaagcgcctcttcttgctggagccaccggggcctgatcgactgcggctaggggggcgcctggccctggcagagctggaggaactcctagaagcagtccatgccaaatccattggggacatcgacccccagctggactgcttcctatccatgacggtctcctggtaccagagcctgatcaaagttctcctaagccgcttcccccagagctgtcgccatttccaaagcccagacttgggaactcagtacctggtgggttcagaagctctcccatcttcacagcaaccctggcactggcttctcaatgggagggaagcagcagagaaactgaagtgttagacactatgtgtcccaccaccccattacagagacatatgacaatgttcagcaggtcatctttaatgcagaggaggagatgggatgtcactcgctgtctggaggcacgtgggtggtgtgcgggccctcactggccagcctctgggtggccccgcctatcccagtatgaacgtagccaactcaagccctctactgtgtctcctgcagggagagggaggcctcggcacctcagcccacaaggagaaaacagcccctgtccgggtccctccagagctcccttccccagggccacgcctcacctcgaggctgatactcacagcccacgaagcctttgtagccttcatcttccagcagttgaaacagataggggaaattcagctctccggggctgctgggctcccctcggcctgggacctgtgccacctgcacatgccctggggacagatgtggacaaatgtggggtccaggctcc

SEQ ID NO: 287597 - DNA, 6418 bp, Homo sapiens
  misc_feature (1090)..(1090): n is a, c, g, or t
  misc_feature (1106)..(1106): n is a, c, g, or t
  misc_feature (3651)..(3651): n is a, c, g, or t
  misc_feature (6412)..(6412): n is a, c, g, or t
aggcagctaaccactgtgccctgctgcaggagcatgcacagcggtgctatgtccgtgggctattccgcagcttgcagcaagcacagagtgtgacctcccaggatttgctgacagcggtagatgcctgtgaggagctactacaagaaatagacatcaccccatttctccttgcattgtgtggccacacttggggtttgcctcatgcacccccaagtcctggtcctctcagccctgggcccttcagcagcagcatggaggagggtgctgaacctcgggaacgagctatcctagcttctgaatccagcatagagaccgaggacctaagcgagcctgagtttcagagcacccgtgtccctggcattccagaccctgggccagagatctctctgacagatgtctgccagctcagaggagaggcccatggtgcccttcatagcgtcatccaggtgggaagcttgggtgagggtagaagaggtgttagagtcctgcctgtgcagagggacaggattctctcctgggcggggggtatgcatgtgtcctgctctagggtagggagtagtatcctgttgaggggtgactgacattctaacctccttctaaaccccacaacaggagaagttcctagagatcagtcgtctccacttccgcacagtgccttccaatccccactacttcttctattgccctccatccagcaggcgagaagatgaggggcctcgggacacagtagacagaaaaatcagtgacctggagttttcagaggctgagcttatgggagaagaaggagacacatctgcctgctgtgtggtcactgagagtgacccagagctagaggtagaataccgggagagccgtgaatcagacctggggcctgctgggctagactctgcctcgctgtcagacgtagacactgtgaatcctgatgaagactccttcagtatcttggggggcgactcacccactgggcctgagagcttccttcatgacctgccaccgctcttcctgcacctcacgtgctccgtgcggctacgtgggcagcacagctcagtacctgtgtgcagcctgcctacctgcctggtttccagtctgnagggccccccagttgnaggccgagttcccttgagggacctcagtgtgactctggatgtcttcatgctgactttgcccctggaagtggagctccccacggcctcggaccctcagcaccaccggtcaacatctgaaagcagtgcttcatttccacgatccccagggcagccatcatctttaaggtcagatgatggcctcgggcccccactgccacccccagaagaggagaggcacccaggactatccaatttggccacgccccacagactggctattgagaccaccatgaatgagatccgctggttgttggaagatgagatggtgggggcactccgaagagggggcatcccacagagtcctgccctgcaccgcgcagctgcccatatccatagttctcctggacgctccacctgccttcgccaaactctgccactgagttttgtatttgggccagagcgttccctcacacaattcaaggaggagttccgccgcctccatctccctggccatgttcttcttgaagaccctgacagtggcttcttctttgtggcagctggccaacagccaggtgggtcccatggggagccttcttcagcggcctgggcttggcacagtcatgaggacagggctgaaggcatcgaaggggagaccctgacagccagcccccaagcacctgggtccccagaggattctgagggtgtccccctcatcagcctgccccgcgtgccacagggagggagtcagcctgggcccagccggggattaagtctcatgtccagtcagggcagtgtggactcagaccacctaggttatgatggtggcagcagtggctcagacagtgagggtcccaatgacacccttggtgagaaggcccccttcacattgcggactccacctgggccagcacctccacagccttcactctcaggcctccctgggccctgcctgcctgacttctggctcattgtccgggtcctgcaggaccgtgtggaagtgtatgcacatgcacggagcctgattcgggaggatggggggccgggcactgagtgtcgccacctgcagcagctcctggtgaggcgagttggggagatctgcagggaggtcaaccagcgactgcttcttcaagaccttcatgacagccacgtgtgtaactctcttctggtggccgagagtgaagaagatctgtggcgcagtgagactcccttccactcccgtcagcgggcaccactgcccagtgatgattatgctgctgatgagagctgtgcgccccgtgggtacctggcagccacaatgcagtttgtccctggccatttctcctgtgacgttgtgtggggaactgtgatccgagtccattcacgcctcaaaatggggcccagcatgggggtctctcgggccatccaggccctgcgctctgtgctcaatgccttctctgtggtgaaccggaaaaacatgtttgtttaccaggagcgagcaacaaaggctgtgtactatcttcggctcctagagacatcctgcagtgaccggccatggaaaggggatgcgctgcccccttccctcgctctgtcccgaagccaagagcccatctactctgaggaagcctcgggtcctcgttctcccttagacatggtctctagccgcagttcagatgctgctcgtcctgtgggccaagtggacagacatatccagctgctggtccatggtgttgggcaggcaggtcctgagatcacggatgagctcgtgcgagttctatgtcggcgcctggatgaggccacgctggacgtcatcacagttatgcttgttcggaactgcaagctgacaccagctgatgtggagttcatccagccccctggaagtctcccctcagaggtgctgcatctggccctacccacctcctgcaggccctggcttccagccctggcatggtacctacggcagaacttgctcatcttcctgcactctcccaagtacacagatagcaacagccggaaccacttccaacatccactcccaccacagggtggcctccctgacttggacatctacttgtataacaagcctggtggacagggcactgggggcaaaggggttgcctgcatcactctagcctttgtggatgaaggaggggcccccttgtcactggcgttgtggcccccctcctctccggggcccccagacccactgcgagaggaggaatttgagcaactgacccaggtcatccgctgcccggttgttgtggacagttcttcagctcagaatggggccccacggcttcgattggatgtgtgggaaaaggggaacattagtattgtgcagctggaggagaaactccgaggagcagctcgccaggccctggccgatgccatcatcgagcttcagctgctgccagcttcactatgtacagaggacacacccacaggaagtctcaggaacggatcgttggaaactaagagctctgcaggccgagctagcacctttccccctgcccctgtccctggggagcctgtgactccacccagcaaagcgggccggcgtagcttctgggatatgctgagtaaaacagantgtggggatttgggttcccccaaaacaactgatgacattgtcctggatcggccagaagacactcggggccggaggcgtcacaaaaccgagagtgttcggactcctggtggagctgagcgggcgccaggctcagattctggagcccagagacaaaagcgccggacaacacagctagaagagggtgaggtggggacccttcatcctgtgtttgcccgtgttgctcagcgctggatggagtttatggttcagattggttgtgcctcagtgtccagaagctctgcccacatggtgtcccggttcctccttccatccatcctgtctgagttcaccgcactggtcacctcaatggctggagacaccagtgtccgcatctttgagcagcatttgggttcagagccagagatcttcggcccttgttcccctgggcaactgggcccctctccccgccctgcagctgagcggcatctgctgcttctgggaaggaacttcttgcagtggaggagaccaacacagcaggctgccaaagccatgcagcgcttcgagccaggaggtgatgggagctcagggcgaaatgctccccggcagaggctcttgctactagaggttgtggacaagaagctacagctgctgacctacaactgggctccagacctgggggcagcattgggccgagcgctggttcgcctggtgcagtggcagaatgcacgagcccatctcatcttctgcctactcagccagaagcttggcctcttccatcattatggccagttggacttccccgtgcgagatgaaaaggagccaaacccattcctgctgccgaccatggaagtggagaccctcatccggagtgcaagtcccccgctgagccgtgagcagggccgactgagtgggtcctctcgtggtgggggtcctcttcccctggacacattcccctttgacgaggccctaagggatatcacggctgcccgccccagctccgtacttggtcctgtgcccagacctcctgatcctgtcacctaccatggacaacagttcctagagatcaagatggcagagcgcagagagctggagcgccagatgaagatggaaaacctgtttgtaacctggcagcagcgttctaccccagccaccatgcccatcagtgctggagagctggagaccctgaagcagtcatcccgcctggtgcattactgtgcaacagccatgctcttcgacccagctgcctggctgcatgggcccccagagacctctggaccccctgacgggcagcggcgccatcgccctgagtcagggtctgggagccgagaggcccccacaagctgtgaatccttggatgtgtcgcccccgggagcccgtgaggagccttggctgaaggagctgagcttggctttcctgcagcaatatgtgcagtatctgcagagcataggttttgtgctggtaccactgcggcccccctcacccgcccgcagcaccagccggccacgggccatggctatccttggaacagagggtcgaggctccttctcctgccctaaaaccaagactgatgggagccccaagagcactagctctccggtaaccacctaccacctgcagcgggcactgcctgggggcatcatcctcatggaactggcattccagggctgttacttctgtgtcaaacagtttgccctggaatgttcccgaatcccaatggggcaggctgtcaactcacagctgtccatgctgttcacagaggagtgtgacaaggtgcgggacctgatgcacgtgcactcgttcagctatgacttccatctgcgcctcgtgcatcagcacgtgctaggtgcccatctggtgctgcggcacggctaccacctcaccacctttctgcgacacttcctggcccaccaccctgacggaccccactttggccgcaatcacatttaccaagggacattggagctccccacaccactcattgctgcccaccagctatacaactacgtggctgatcacgccagctcttaccacatgaagccattgcgaatggcccggccagggggcccagaacacaacgagtatgccctggtgtcggcatggcacagttctggctcctacctggactctgagggacttcgacaccaggatgactttgatgtgtctctgcttgtctgtcactgtgctgcaccctttgaggagcaaggagaggctgagcggcacgttctgcggctacagttcttcgtggtgctcaccagccagcgagagctcttccccaggctcactgctgacatgcgccgcttccggaagccacccagactgccccctgagccagaggctcctgggagttcagctggcagccctggggaggcctcagggcttattctagcgcctggaccggctcctctgttcccaccactggctgcagaggtgggcatggcacgagcacggctggctcagctggtgcggctggctggagggcactgccgtcgggacaccctttggaagcgcctcttcttgctggagccaccggggcctgatcgactgcggctaggggggcgcctggccctggcagagctggaggaactcctagaagcagtccatgccaaatccattggggacatcgacccccagctggactgcttcctatccatgacggtctcctggtaccagagcctgatcaaagttctcctaagccgcttcccccagagctgtcgccatttccaaagcccagacttgggaactcagtacctgtaagttaccctgggttggggcttgaattcanaaagtt

SEQ ID NO: 287598 - DNA, 6430 bp, Homo sapiens
  misc_feature (1090)..(1090): n is a, c, g, or t
  misc_feature (1106)..(1106): n is a, c, g, or t
  misc_feature (3651)..(3651): n is a, c, g, or t
aggcagctaaccactgtgccctgctgcaggagcatgcacagcggtgctatgtccgtgggctattccgcagcttgcagcaagcacagagtgtgacctcccaggatttgctgacagcggtagatgcctgtgaggagctactacaagaaatagacatcaccccatttctccttgcattgtgtggccacacttggggtttgcctcatgcacccccaagtcctggtcctctcagccctgggcccttcagcagcagcatggaggagggtgctgaacctcgggaacgagctatcctagcttctgaatccagcatagagaccgaggacctaagcgagcctgagtttcagagcacccgtgtccctggcattccagaccctgggccagagatctctctgacagatgtctgccagctcagaggagaggcccatggtgcccttcatagcgtcatccaggtgggaagcttgggtgagggtagaagaggtgttagagtcctgcctgtgcagagggacaggattctctcctgggcggggggtatgcatgtgtcctgctctagggtagggagtagtatcctgttgaggggtgactgacattctaacctccttctaaaccccacaacaggagaagttcctagagatcagtcgtctccacttccgcacagtgccttccaatccccactacttcttctattgccctccatccagcaggcgagaagatgaggggcctcgggacacagtagacagaaaaatcagtgacctggagttttcagaggctgagcttatgggagaagaaggagacacatctgcctgctgtgtggtcactgagagtgacccagagctagaggtagaataccgggagagccgtgaatcagacctggggcctgctgggctagactctgcctcgctgtcagacgtagacactgtgaatcctgatgaagactccttcagtatcttggggggcgactcacccactgggcctgagagcttccttcatgacctgccaccgctcttcctgcacctcacgtgctccgtgcggctacgtgggcagcacagctcagtacctgtgtgcagcctgcctacctgcctggtttccagtctgnagggccccccagttgnaggccgagttcccttgagggacctcagtgtgactctggatgtcttcatgctgactttgcccctggaagtggagctccccacggcctcggaccctcagcaccaccggtcaacatctgaaagcagtgcttcatttccacgatccccagggcagccatcatctttaaggtcagatgatggcctcgggcccccactgccacccccagaagaggagaggcacccaggactatccaatttggccacgccccacagactggctattgagaccaccatgaatgagatccgctggttgttggaagatgagatggtgggggcactccgaagagggggcatcccacagagtcctgccctgcaccgcgcagctgcccatatccatagttctcctggacgctccacctgccttcgccaaactctgccactgagttttgtatttgggccagagcgttccctcacacaattcaaggaggagttccgccgcctccatctccctggccatgttcttcttgaagaccctgacagtggcttcttctttgtggcagctggccaacagccaggtgggtcccatggggagccttcttcagcggcctgggcttggcacagtcatgaggacagggctgaaggcatcgaaggggagaccctgacagccagcccccaagcacctgggtccccagaggattctgagggtgtccccctcatcagcctgccccgcgtgccacagggagggagtcagcctgggcccagccggggattaagtctcatgtccagtcagggcagtgtggactcagaccacctaggttatgatggtggcagcagtggctcagacagtgagggtcccaatgacacccttggtgagaaggcccccttcacattgcggactccacctgggccagcacctccacagccttcactctcaggcctccctgggccctgcctgcctgacttctggctcattgtccgggtcctgcaggaccgtgtggaagtgtatgcacatgcacggagcctgattcgggaggatggggggccgggcactgagtgtcgccacctgcagcagctcctggtgaggcgagttggggagatctgcagggaggtcaaccagcgactgcttcttcaagaccttcatgacagccacgtgtgtaactctcttctggtggccgagagtgaagaagatctgtggcgcagtgagactcccttccactcccgtcagcgggcaccactgcccagtgatgattatgctgctgatgagagctgtgcgccccgtgggtacctggcagccacaatgcagtttgtccctggccatttctcctgtgacgttgtgtggggaactgtgatccgagtccattcacgcctcaaaatggggcccagcatgggggtctctcgggccatccaggccctgcgctctgtgctcaatgccttctctgtggtgaaccggaaaaacatgtttgtttaccaggagcgagcaacaaaggctgtgtactatcttcggctcctagagacatcctgcagtgaccggccatggaaaggggatgcgctgcccccttccctcgctctgtcccgaagccaagagcccatctactctgaggaagcctcgggtcctcgttctcccttagacatggtctctagccgcagttcagatgctgctcgtcctgtgggccaagtggacagacatatccagctgctggtccatggtgttgggcaggcaggtcctgagatcacggatgagctcgtgcgagttctatgtcggcgcctggatgaggccacgctggacgtcatcacagttatgcttgttcggaactgcaagctgacaccagctgatgtggagttcatccagccccctggaagtctcccctcagaggtgctgcatctggccctacccacctcctgcaggccctggcttccagccctggcatggtacctacggcagaacttgctcatcttcctgcactctcccaagtacacagatagcaacagccggaaccacttccaacatccactcccaccacagggtggcctccctgacttggacatctacttgtataacaagcctggtggacagggcactgggggcaaaggggttgcctgcatcactctagcctttgtggatgaaggaggggcccccttgtcactggcgttgtggcccccctcctctccggggcccccagacccactgcgagaggaggaatttgagcaactgacccaggtcatccgctgcccggttgttgtggacagttcttcagctcagaatggggccccacggcttcgattggatgtgtgggaaaaggggaacattagtattgtgcagctggaggagaaactccgaggagcagctcgccaggccctggccgatgccatcatcgagcttcagctgctgccagcttcactatgtacagaggacacacccacaggaagtctcaggaacggatcgttggaaactaagagctctgcaggccgagctagcacctttccccctgcccctgtccctggggagcctgtgactccacccagcaaagcgggccggcgtagcttctgggatatgctgagtaaaacagantgtggggatttgggttcccccaaaacaactgatgacattgtcctggatcggccagaagacactcggggccggaggcgtcacaaaaccgagagtgttcggactcctggtggagctgagcgggcgccaggctcagattctggagcccagagacaaaagcgccggacaacacagctagaagagggtgaggtggggacccttcatcctgtgtttgcccgtgttgctcagcgctggatggagtttatggttcagattggttgtgcctcagtgtccagaagctctgcccacatggtgtcccggttcctccttccatccatcctgtctgagttcaccgcactggtcacctcaatggctggagacaccagtgtccgcatctttgagcagcatttgggttcagagccagagatcttcggcccttgttcccctgggcaactgggcccctctccccgccctgcagctgagcggcatctgctgcttctgggaaggaacttcttgcagtggaggagaccaacacagcaggctgccaaagccatgcagcgcttcgagccaggaggtgatgggagctcagggcgaaatgctccccggcagaggctcttgctactagaggttgtggacaagaagctacagctgctgacctacaactgggctccagacctgggggcagcattgggccgagcgctggttcgcctggtgcagtggcagaatgcacgagcccatctcatcttctgcctactcagccagaagcttggcctcttccatcattatggccagttggacttccccgtgcgagatgaaaaggagccaaacccattcctgctgccgaccatggaagtggagaccctcatccggagtgcaagtcccccgctgagccgtgagcagggccgactgagtgggtcctctcgtggtgggggtcctcttcccctggacacattcccctttgacgaggccctaagggatatcacggctgcccgccccagctccgtacttggtcctgtgcccagacctcctgatcctgtcacctaccatggacaacagttcctagagatcaagatggcagagcgcagagagctggagcgccagatgaagatggaaaacctgtttgtaacctggcagcagcgttctaccccagccaccatgcccatcagtgctggagagctggagaccctgaagcagtcatcccgcctggtgcattactgtgcaacagccatgctcttcgacccagctgcctggctgcatgggcccccagagacctctggaccccctgacgggcagcggcgccatcgccctgagtcagggtctgggagccgagaggcccccacaagctgtgaatccttggatgtgtcgcccccgggagcccgtgaggagccttggctgaaggagctgagcttggctttcctgcagcaatatgtgcagtatctgcagagcataggttttgtgctggtaccactgcggcccccctcacccgcccgcagcaccagccggccacgggccatggctatccttggaacagagggtcgaggctccttctcctgccctaaaaccaagactgatgggagccccaagagcactagctctccggtaaccacctaccacctgcagcgggcactgcctgggggcatcatcctcatggaactggcattccagggctgttacttctgtgtcaaacagtttgccctggaatgttcccgaatcccaatggggcaggctgtcaactcacagctgtccatgctgttcacagaggagtgtgacaaggtgcgggacctgatgcacgtgcactcgttcagctatgacttccatctgcgcctcgtgcatcagcacgtgctaggtgcccatctggtgctgcggcacggctaccacctcaccacctttctgcgacacttcctggcccaccaccctgacggaccccactttggccgcaatcacatttaccaagggacattggagctccccacaccactcattgctgcccaccagctatacaactacgtggctgatcacgccagctcttaccacatgaagccattgcgaatggcccggccagggggcccagaacacaacgagtatgccctggtgtcggcatggcacagttctggctcctacctggactctgagggacttcgacaccaggatgactttgatgtgtctctgcttgtctgtcactgtgctgcaccctttgaggagcaaggagaggctgagcggcacgttctgcggctacagttcttcgtggtgctcaccagccagcgagagctcttccccaggctcactgctgacatgcgccgcttccggaagccacccagactgccccctgagccagaggctcctgggagttcagctggcagccctggggaggcctcagggcttattctagcgcctggaccggctcctctgttcccaccactggctgcagaggtgggcatggcacgagcacggctggctcagctggtgcggctggctggagggcactgccgtcgggacaccctttggaagcgcctcttcttgctggagccaccggggcctgatcgactgcggctaggggggcgcctggccctggcagagctggaggaactcctagaagcagtccatgccaaatccattggggacatcgacccccagctggactgcttcctatccatgacggtctcctggtaccagagcctgatcaaagttctcctaagccgcttcccccagagctgtcgccatttccaaagcccagacttgggaactcagtacctgagggcgctcgtcacgctcttgctccagagtcccgtcatagatacgcaac

SEQ ID NO: 287599 - DNA, 4098 bp, Homo sapiens
  misc_feature (1090)..(1090): n is a, c, g, or t
  misc_feature (1106)..(1106): n is a, c, g, or t
aggcagctaaccactgtgccctgctgcaggagcatgcacagcggtgctatgtccgtgggctattccgcagcttgcagcaagcacagagtgtgacctcccaggatttgctgacagcggtagatgcctgtgaggagctactacaagaaatagacatcaccccatttctccttgcattgtgtggccacacttggggtttgcctcatgcacccccaagtcctggtcctctcagccctgggcccttcagcagcagcatggaggagggtgctgaacctcgggaacgagctatcctagcttctgaatccagcatagagaccgaggacctaagcgagcctgagtttcagagcacccgtgtccctggcattccagaccctgggccagagatctctctgacagatgtctgccagctcagaggagaggcccatggtgcccttcatagcgtcatccaggtgggaagcttgggtgagggtagaagaggtgttagagtcctgcctgtgcagagggacaggattctctcctgggcggggggtatgcatgtgtcctgctctagggtagggagtagtatcctgttgaggggtgactgacattctaacctccttctaaaccccacaacaggagaagttcctagagatcagtcgtctccacttccgcacagtgccttccaatccccactacttcttctattgccctccatccagcaggcgagaagatgaggggcctcgggacacagtagacagaaaaatcagtgacctggagttttcagaggctgagcttatgggagaagaaggagacacatctgcctgctgtgtggtcactgagagtgacccagagctagaggtagaataccgggagagccgtgaatcagacctggggcctgctgggctagactctgcctcgctgtcagacgtagacactgtgaatcctgatgaagactccttcagtatcttggggggcgactcacccactgggcctgagagcttccttcatgacctgccaccgctcttcctgcacctcacgtgctccgtgcggctacgtgggcagcacagctcagtacctgtgtgcagcctgcctacctgcctggtttccagtctgnagggccccccagttgnaggccgagttcccttgagggacctcagtgtgactctggatgtcttcatgctgactttgcccctggaagtggagctccccacggcctcggaccctcagcaccaccggtcaacatctgaaagcagtgcttcatttccacgatccccagggcagccatcatctttaaggtcagatgatggcctcgggcccccactgccacccccagaagaggagaggcacccaggactatccaatttggccacgccccacagactggctattgagaccaccatgaatgagatccgctggttgttggaagatgagatggtgggggcactccgaagagggggcatcccacagagtcctgccctgcaccgcgcagctgcccatatccatagttctcctggacgctccacctgccttcgccaaactctgccactgagttttgtatttgggccagagcgttccctcacacaattcaaggaggagttccgccgcctccatctccctggccatgttcttcttgaagaccctgacagtggcttcttctttgtggcagctggccaacagccaggtgggtcccatggggagccttcttcagcggcctgggcttggcacagtcatgaggacagggctgaaggcatcgaaggggagaccctgacagccagcccccaagcacctgggtccccagaggattctgagggtgtccccctcatcagcctgccccgcgtgccacagggagggagtcagcctgggcccagccggggattaagtctcatgtccagtcagggcagtgtggactcagaccacctaggttatgatggtggcagcagtggctcagacagtgagggtcccaatgacacccttggtgagaaggcccccttcacattgcggactccacctgggccagcacctccacagccttcactctcaggcctccctgggccctgcctgcctgacttctggctcattgtccgggtcctgcaggaccgtgtggaagtgtatgcacatgcacggagcctgattcgggaggatggggggccgggcactgagtgtcgccacctgcagcagctcctggtgaggcgagttggggagatctgcagggaggtcaaccagcgactgcttcttcaagaccttcatgacagccacgtgtgtaactctcttctggtggccgagagtgaagaagatctgtggcgcagtgagactcccttccactcccgtcagcgggcaccactgcccagtgatgattatgctgctgatgagagctgtgcgccccgtgggtacctggcagccacaatgcagtttgtccctggccatttctcctgtgacgttgtgtggggaactgtgatccgagtccattcacgcctcaaaatggggcccagcatgggggtctctcgggccatccaggccctgcgctctgtgctcaatgccttctctgtggtgaaccggaaaaacatgtttgtttaccaggagcgagcaacaaaggctgtgtactatcttcggctcctagagacatcctgcagtgaccggccatggaaaggggatgcgctgcccccttccctcgctctgtcccgaagccaagagcccatctactctgaggaagcctcgggtcctcgttctcccttagacatggtctctagccgcagttcagatgctgctcgtcctgtgggccaagtggacagacatatccagctgctggtccatggtgttgggcaggcaggtcctgagatcacggatgagctcgtgcgagttctatgtcggcgcctggatgaggccacgctggacgtcatcacagttatgcttgttcggaactgcaagctgacaccagctgatgtggagttcatccagccccctggaagtctcccctcagaggtgctgcatctggccctacccacctcctgcaggccctggcttccagccctggcatggtacctacggcagaacttgctcatcttcctgcactctcccaagtacacagatagcaacagccggaaccacttccaacatccactcccaccacagggtggcctccctgacttggacatctacttgtataacaagcctggtggacagggcactgggggcaaaggggttgcctgcatcactctagcctttgtggatgaaggaggggcccccttgtcactggcgttgtggcccccctcctctccggggcccccagacccactgcgagaggaggaatttgagcaactgacccaggtcatccgctgcccggttgttgtggacagttcttcagctcagaatggggccccacggcttcgattggatgtgtgggaaaaggggaacattagtattgtgcagctggaggagaaactccgaggagcagctcgccaggccctggccgatgccatcatcgagcttcagctgctgccagcttcactatgtacagaggacacacccacaggaagtctcaggaacggatcgttggaaactaagagctctgcaggccgagctagcacctttccccctgcccctgtccctggggagcctgtgactccacccagcaaagcgggccggcgtagcttctgggatatgctggtaatggaagaagtggtgaagtgggcatctacctttctgcctgcctcctagctcctcccacactccctcctgcttcccagtcccccataggccttgccacagtgtcctttcatataaaactgctctgtcctgccagacaccatggcgtgtacctttagtcccagctcctcaggaggatgaaatgggaggattttgcttcaggccaagagttcaaggctgtagtatgttgtgatcatgcctgttaatgcactccagcctgggcaacacacaaacactctgtctcaaaaaagcaaaacaaaaactgctctgtcttttggactggagtttgtagaatgtggcagttctcactgatgtagagggagccttaacttactatgtgccttcacttccatttttcttgtcggatcctcacaacagcttgcaagataagtagagcttttacagtgaggaaggtgaggc

SEQ ID NO: 287600 - DNA, 415 bp, Homo sapiens
agtggagacagccagacccacctgtctctcgccttcctgatctcatcttcaccttccctccagggctgttacttctgtgtcaaacagtttgccctggaatgttcccgaatcccaatggggcaggctgtcaactcacaggtatgtgaatgagctgcgggcacagtcagtgcaccccagtgtgctgtgggcagcatggctccatgtcccatttgctgggcagtagagtaatgcagtaggcgggctggcccagtgattgattcactgctatggcctggctaggtcagtgctcattctggtgccatgactgcactcactacaaggctgaccccatcggtcatccaaagcgtgttcagctgtagccctgaggcagcacagtgcctggtctggcctgtagtcatctagagtctgtggcaga

SEQ ID NO: 287601 - DNA, 548 bp, Homo sapiens
tgtgacctcagggtgcaggcggggtgaggtgtggagatggaagtaggcctctcctcatcctcccttcacctcaggatgccctgtgggagggtctgtagggtctgtgtcccctcctcatctttcactgcaggttgtgctgaatcagaagttcactgactgctttgtgctagtgtttctggactcccacttaggaaagacggtaagaacgagtggggggctttgtgtcagcctcatgggaggccgtaccccaaatgctccacctcggagcctgctgaggttggggtgcccaccctttctgagccctgcctcctatccccacccatgccctcctctcaccagtgcatccccaccgtgttccccacagtctctgacagtggttttccgagagcccttcccagtacagccccaggacagcgagagcccccctgcccaactggtctccacctaccaccacctggagtctgtcatcaacacagcctgtttcaccctctggacccgcctcctctgagggagtggactggaccactgaatgtcactgttccttgaat

SEQ ID NO: 287602 - DNA, 793 bp, Homo sapiens
gacagacatgcttctcaaagtacagaatgctattggagaactgtatcttgaaactggaatgactcaggaagggttccagtatttccagaaagcatggtcaagcatgctgcatctttcactcagtgacttagaagacagccgggacttggtgaagcagaaagtcagagttttggacaatctggcaaagtcagcatctgaagaatacttaaaagaaaaccacattttggaatatgcaactgaaatttccaacttactggataacaatccccgtgatcaagctaccatgaaatacatcgaaggtgttctaatgttcgttgctggaaatacctctcttgcaaaaatgaaacttcgagagtgcttaaatatcaggaaaagcttgtttggcaagaaaaacatgctggttggagaagttatggaatttttagtggatttgctattttttccccagagagatagtaaaaaatcccaaaggaagcaagtacttaaatattataaacaagtgataaaaataaaggaaaatgcagaaactctggccaagtcctcactcctcaggaagcaactgagcatcagcctcagcgatacgttgtgtaaattagccttctgagagaaattgagtggatccggagccggagatattggcctcaaggtatgagccagcaacattctgagggttctaggaatggcttctcattatgggagcacttggttaaattaaactaccacagtgctcagagttctaatacagtgagctctgcaatgtgcatgaatgcagataaattacacagggctagaa

SEQ ID NO: 287603 - DNA, 686 bp, Homo sapiens
aagaggaagtgaacagctctgtcaaacgctgctgctgggtggagctccctgaagacagagagtgaacccttggttttcgccatgtagaggtctgctgtgctgagactcatggcaaaccccaggagccacctatgatgtgccagacacataagcccctccctcacaggcgtgggtgcagccggggccgaccgcattccaaggagcatttcctctgaaagccaggccaagtgcccgctctccagcgattttggtctaggcaacatcagatgaaaacgaacactaagggcaatcctgaagaaccaaaagaaactggcaatggacaggggtgaattgcatcctgtactgtttacagccttatctccaacttttgcagagtcaagaatttaaaagcagcagggcttggtggcccatgcctgtaatcccaatattttgggaggccgcagcgggaggatcacttgaggccaggagttccagacctccctgggcaacatgatgagaccacatctctacagaaaaattagctgggcatgctggcatgtgcctgtagtcccagctcctcaagaggctgaggtgggaggatcacttgagcccaggaggtcaaggctgcagtgagctatgatcacaccaatgcactctagcctggggacacagtgagaccctgtctcaaaaaaaaaaaaaagaggaat

SEQ ID NO: 287604 - DNA, 436 bp, Homo sapiens
aagaggaagtgaacagctctgtcaaacgctgctgctgggtggagctccctgaagacagagagtgaacccttggttttcgccatgtagaggtctgctgtgctgagactcatggcaaaccccaggagccacctatgatgtgccagacacataagcccctccctcacaggcgtgggtgcagccggggccgaccgcattccaaggagcatttcctctgaaagccaggccaagtgcccgctctccagcgtgagtcaagcagtgccatgcctcccacaccccttgcatcacatctctgggaatgcacagaccttgctgttacgctctctcttcccaccctttatgggtgttttctttaagtggcagaaggaagtgggcatgggttgggagaggaccatgaattctagtttctgccatactgcaggtggatttggggaagaag

SEQ ID NO: 287605 - DNA, 5155 bp, Homo sapiens
gggatgccgaggagccggggcggccgcgccgcgccggggccgccgccgccgccgccgccgccgggccaggccccgcgctggagccgctggcgggtccctgggcggctgctgctgctgctgctgcccgcgctctgctgcctcccgggcgccgcgcgggcggcggcggcggcggcgggggcagggaaccgggcagcggtggcggtggcggtggcgcgggcggacgaggcggaggcgcccttcgccgggcagaactggttaaagtcctatggctatctgcttccctatgactcacgggcatctgcgctgcactcagcgaaggccttgcagtcggcagtctccactatgcagcagttttacgggatcccggtcaccggtgtgttggatcagacaacgatcgagtggatgaagaaaccccgatgtggtgtccctgatcacccccacttaagccgtaggcggagaaacaagcgctatgccctgactggacagaagtggaggcaaaaacacatcacctacagcattcacaactataccccaaaagtgggtgagctagacacgcggaaagctattcgccaggctttcgatgtgtggcagaaggtgaccccactgacctttgaagaggtgccataccatgagatcaaaagtgaccggaaggaggcagacatcatgatcttttttgcttctggtttccatggcgacagctccccatttgatggagaagggggattcctggcccatgcctacttccctggcccagggattggaggagacacccactttgactccgatgagccatggacgctaggaaatgccaaccatgacgggaacgacctcttcctggtggctgtgcatgagctgggccacgcgctgggactggagcactccagcgaccccagcgccatcatggcgcccttctaccagtacatggagacgcacaacttcaagctgccccaggacgatctccagggcatccagaagatctatggacccccagccgagcctctggagcccacaaggccactccctacactccccgtccgcaggatccactcaccatcggagaggaaacacgagcgccagcccaggccccctcggccgcccctcggggaccggccatccacaccaggcaccaaacccaacatctgtgacggcaacttcaacacagtggccctcttccggggcgagatgtttgtctttaaggatcgctggttctggcgtctgcgcaataaccgagtgcaggagggctaccccatgcagatcgagcagttctggaagggcctgcctgcccgcatcgacgcagcctatgaaagggccgatgggagatttgtcttcttcaaaggtgacaagtattgggtgtttaaggaggtgacggtggagcctgggtacccccacagcctgggggagctgggcagctgtttgccccgtgaaggcattgacacagctctgcgctgggaacctgtgggcaagacctactttttcaaaggcgagcggtactggcgctacagcgaggagcggcgggccacggaccctggctaccctaagcccatcaccgtgtggaagggcatcccacaggctccccaaggagccttcatcagcaaggaaggatattacacctatttctacaagggccgggactactggaagtttgacaaccagaaactgagcgtggagccaggctacccgcgcaacatcctgcgtgactggatgggctgcaaccagaaggaggtggagcggcggaaggagcggcggctgccccaggacgacgtggacatcatggtgaccatcaacgatgtgccgggctccgtgaacgccgtggccgtggtcatcccctgcatcctgtccctctgcatcctggtgctggtctacaccatcttccagttcaagaacaagacaggccctcagcctgtcacctactataagcggccagtccaggaatgggtgtgagcagcccagagccctctctatccacttggtctggccagccaggcccttcctcaccagggtctgaggggcagctctggccagtgctcaccagggccagcagggccctaggctggggtcgtacagctgaagtggtgggtgcattggcctaggctgagcgtggggcagggaattatgggggctgtgccccagggtgggtgtctggcacccagctgccagccttctgtcctgggcaaactactccctacttaagggaataggccaggctccatccggaggcagggaccatgccaggaggagcccctgtggtcacggcatcctgtggtgtccatgaggtaccacagctccactcctggctggaacccagcaccctctgtgggaagccagcactagctctcatcccccatccgggagataccaccagtcctggtccccttttgccaacacctgctggtcagatgtccccctacccccaccccactgtcctccaaggctacaggacccctgcttctgacacagtgagcaacaagcctgggtttccctgctggcagacggcagatccctcaggaaacctgctccacttgtcagggtctcttcggagacccaggatttagggtcacatgctgcaggcagggctgtggcccagctgggtctgacaaggacccagctgtcacatcgtgaatatttaaatgtcctgtcactactgtcccattttgcaaaggctgcttgaggctttaggtgaactagaggtgactgtcttggtgatgaggccagcatagcggccctcccccaggcgacaaggaccaaggtgctgctaaggccactctagcgcccagacaccccagtagctgagctctgctcctatggctacagagctggggcagaagctgaccccatttctggaggaagatccgagtttgtgaccgtcctccactcccctctattgtcactgtccccagctttgctccagtctgtcacttgcagcctggagctcagcctcaccagttaggtgaggcagagatggctgcagggccaacactggcagagcctgggagtccttcggaaggggaccagggcgtctgaagtgctcagtgcccccactactctgaggccgactccagctactctgaggccgactcaatctctcggctggaagcagtgttttcccagagcttggcccttgctgacctcgctcactgggcccatcttcccacactgctcttagaaggacacccctaccggtagcagccccaagctgagggggctccctttttgaccttcactggcccgcccttcactgtctccagcaggagttcctagggcttggcctgccttgctccacagtacggcggaggcagccctgcttgtcactgaggagccctagacaaggccaatgggttcatcaatgcccactggctctctgccaaagccaaaaaggtgtcaggcagtctccagcgtgctggccgggtctcggatgccacccctgctcactgagcctgcatgggccttgcccccgaccctgtggtctctgggattggggtcggcttaccctgtagcacagacagggactcctgctgccctgggagctgtctcaagcaaaatctcttgtcccagaggtgcccatgtgggtccgctgtgtcccctgtcatcatccttgttttttctcattttggccaagggcaggctccctgggacaggcagggaacaactgcggagatattagtgattcataggtttgtacagtgttttatactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccattggctcctggcaggccagctgagaatgaacaggagatggaggcaggcagcccaggctgcagaggtgagggatgtggggccaggcccagagggctcagcctagaggcttccaatctcagattctcctgcctgtggtcatctgtttgtccatcaccccaggacagggcagacagaggggcaaagcactgggggccccagagcctagcttcccctcagcctgggggacatcacagcatttcagtgtcagtcacattttaaactgatcagcctttgtataatgttttttaaatcatttctaaataaaacagaaatacagagtgagtgtgtcatttccctgggatgagggaacaaagatcaggttccaagagtaaccttaggacgctctgggaagagaaccgggtcctttggggtgtctgggagctgcccacccatctcctctgccagaccggcggtcagatagcctccctctacaacaggctggccctgggggcccagggttattggggttccaggaacacagcctgatgatgcctccttacgatccaggatggagagcagcccccccaggagtatggggagggtcactgtggcacgggcttctccatgacctgggacatgaccaggaggcctgtcctgcctctggaagccagcgacagagagggatgcccccgacccagccagccggagaaagggatggggtggtcacgaaggtctgagctgggtctgggtgtaggctgggaagcaggctggggtgtagactgcgaaggcggccctgccgggacttctttccagtccccggcgacctcttcgaattctctgctatctctggggagcctcgggtgggagggggtgtaagagacgcagggacgtggggagaggagacaaggcaggcaagaaccacaggggacggcggacagacgggcgacatcctgcggaggacgccgtcagtaccaggaagtgcaggcgatgaggaagcgcacgtcgtccagcggcccccacgggctgggctcgggctggggctggggctggggctggggctggggctggggcggatgccggggctgttccgggccctccggcgccgcaggctggggctggggctggggctgggtttgcgcaggctccggggcgccgcggccgct

SEQ ID NO: 287606 - DNA, 5247 bp, Homo sapiens
gggatgccgaggagccggggcggccgcgccgcgccggggccgccgccgccgccgccgccgccgggccaggccccgcgctggagccgctggcgggtccctgggcggctgctgctgctgctgctgcccgcgctctgctgcctcccgggcgccgcgcgggcggcggcggcggcggcgggggcagggaaccgggcagcggtggcggtggcggtggcgcgggcggacgaggcggaggcgcccttcgccgggcagaactggttaaagtcctatggctatctgcttccctatgactcacgggcatctgcgctgcactcagcgaaggccttgcagtcggcagtctccactatgcagcagttttacgggatcccggtcaccggtgtgttggatcagacaacgatcgagtggatgaagaaaccccgatgtggtgtccctgatcacccccacttaagccgtaggcggagaaacaagcgctatgccctgactggacagaagtggaggcaaaaacacatcacctacagcattcacaactataccccaaaagtgggtgagctagacacgcggaaagctattcgccaggctttcgatgtgtggcagaaggtgaccccactgacctttgaagaggtgccataccatgagatcaaaagtgaccggaaggaggcagacatcatgatcttttttgcttctggtttccatggcgacagctccccatttgatggagaagggggattcctggcccatgcctacttccctggcccagggattggaggagacacccactttgactccgatgagccatggacgctaggaaatgccaaccatgacgggaacgacctcttcctggtggctgtgcatgagctgggccacgcgctgggactggagcactccagcgaccccagcgccatcatggcgcccttctaccagtacatggagacgcacaacttcaagctgccccaggacgatctccagggcatccagaagatctatggacccccagccgagcctctggagcccacaaggccactccctacactccccgtccgcaggatccactcaccatcggagaggaaacacgagcgccagcccaggccccctcggccgcccctcggggaccggccatccacaccaggcaccaaacccaacatctgtgacggcaacttcaacacagtggccctcttccggggcgagatgtttgtctttaaggatcgctggttctggcgtctgcgcaataaccgagtgcaggagggctaccccatgcagatcgagcagttctggaagggcctgcctgcccgcatcgacgcagcctatgaaagggccgatgggagatttgtcttcttcaaaggtgacaagtattgggtgtttaaggaggtgacggtggagcctgggtacccccacagcctgggggagctgggcagctgtttgccccgtgaaggcattgacacagctctgcgctgggaacctgtgggcaagacctactttttcaaaggcgagcggtactggcgctacagcgaggagcggcgggccacggaccctggctaccctaagcccatcaccgtgtggaagggcatcccacaggctccccaaggagccttcatcagcaaggaaggatattacacctatttctacaagggccgggactactggaagtttgacaaccagaaactgagcgtggagccaggctacccgcgcaacatcctgcgtgactggatgggctgcaaccagaaggaggtggagcggcggaaggagcggcggctgccccaggacgacgtggacatcatggtgaccatcaacgatgtgccgggctccgtgaacgccgtggccgtggtcatcccctgcatcctgtccctctgcatcctggtgctggtctacaccatcttccagttcaagaacaagacaggccctcagcctgtcacctactataagcggccagtccaggaatgggtgtgagcagcccagagccctctctatccacttggtctggccagccaggcccttcctcaccagggtctgaggggcagctctggccagtgctcaccagggccagcagggccctaggctggggtcgtacagctgaagtggtgggtgcattggcctaggctgagcgtggggcagggaattatgggggctgtgccccagggtgggtgtctggcacccagctgccagccttctgtcctgggcaaactactccctacttaagggaataggccaggctccatccggaggcagggaccatgccaggaggagcccctgtggtcacggcatcctgtggtgtccatgaggtaccacagctccactcctggctggaacccagcaccctctgtgggaagccagcactagctctcatcccccatccgggagataccaccagtcctggtccccttttgccaacacctgctggtcagatgtccccctacccccaccccactgtcctccaaggctacaggacccctgcttctgacacagtgagcaacaagcctgggtttccctgctggcagacggcagatccctcaggaaacctgctccacttgtcagggtctcttcggagacccaggatttagggtcacatgctgcaggcagggctgtggcccagctgggtctgacaaggacccagctgtcacatcgtgaatatttaaatgtcctgtcactactgtcccattttgcaaaggctgcttgaggctttaggtgaactagaggtgactgtcttggtgatgaggccagcatagcggccctcccccaggcgacaaggaccaaggtgctgctaaggccactctagcgcccagacaccccagtagctgagctctgctcctatggctacagagctggggcagaagctgaccccatttctggaggaagatccgagtttgtgaccgtcctccactcccctctattgtcactgtccccagctttgctccagtctgtcacttgcagcctggagctcagcctcaccagttaggtgaggcagagatggctgcagggccaacactggcagagcctgggagtccttcggaaggggaccagggcgtctgaagtgctcagtgcccccactactctgaggccgactccagctactctgaggccgactcaatctctcggctggaagcagtgttttcccagagcttggcccttgctgacctcgctcactgggcccatcttcccacactgctcttagaaggacacccctaccggtagcagccccaagctgagggggctccctttttgaccttcactggcccgcccttcactgtctccagcaggagttcctagggcttggcctgccttgctccacagtacggcggaggcagccctgcttgtcactgaggagccctagacaaggccaatgggttcatcaatgcccactggctctctgccaaagccaaaaaggtgtcaggcagtctccagcgtgctggccgggtctcggatgccacccctgctcactgagcctgcatgggccttgcccccgaccctgtggtctctgggattggggtcggcttaccctgtagcacagacagggactcctgctgccctgggagctgtctcaagcaaaatctcttgtcccagaggtgcccatgtgggtccgctgtgtcccctgtcatcatccttgttttttctcattttggccaagggcaggctccctgggacaggcagggaacaactgcggagatattagtgattcataggtttgtacagtgttttatactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccattggctcctggcaggccagctgagaatgaacaggagatggaggcaggcagcccaggctgcagaggtgagggatgtggggccaggcccagagggctcagcctagaggcttccaatctcagattctcctgcctgtggtcatctgtttgtccatcaccccaggacagggcagacagaggggcaaagcactgggggccccagagcctagcttcccctcagcctgggggacatcacagcatttcagtgtcagtcacattttaaactgatcagcctttgtataatgttttttaaatcatttctaaataaaacagaaatacagagtgagtgtgtcatttccctgggatgagggaacaaagatcaggttccaagagtaaccttaggacgctctgggaagagaaccgggtcctttggggtgtctgggagctgcccacccatctcctctgccagaccggcggtcagatagcctccctctacaacaggctggccctgggggcccagggttattggggttccaggaacacagcctgatgatgcctccttacgatccaggatggagagcagcccccccaggagtatggggagggtcactgtggcacgggcttctccatgacctgggacatgacctgggacacatagtcaagagcacggttatcagcaatacagatattaataaaaggcagacgaagtcaggaggtcagcaactttgcgggcttaccaggaggcctgtcctgcctctggaagccagcgacagagagggatgcccccgacccagccagccggagaaagggatggggtggtcacgaaggtctgagctgggtctgggtgtaggctgggaagcaggctggggtgtagactgcgaaggcggccctgccgggacttctttccagtccccggcgacctcttcgaattctctgctatctctggggagcctcgggtgggagggggtgtaagagacgcagggacgtggggagaggagacaaggcaggcaagaaccacaggggacggcggacagacgggcgacatcctgcggaggacgccgtcagtaccaggaagtgcaggcgatgaggaagcgcacgtcgtccagcggcccccacgggctgggctcgggctggggctggggctggggctggggctggggctggggcggatgccggggctgttccgggccctccggcgccgcaggctggggctggggctggggctgggtttgcgcaggctccggggcgccgcggccgct

SEQ ID NO: 287607 - DNA, 4330 bp, Homo sapiens
gggatgccgaggagccggggcggccgcgccgcgccggggccgccgccgccgccgccgccgccgggccaggccccgcgctggagccgctggcgggtccctgggcggctgctgctgctgctgctgcccgcgctctgctgcctcccgggcgccgcgcgggcggcggcggcggcggcgggggcagggaaccgggcagcggtggcggtggcggtggcgcgggcggacgaggcggaggcgcccttcgccgggcagaactggttaaagtcctatggctatctgcttccctatgactcacgggcatctgcgctgcactcagcgaaggccttgcagtcggcagtctccactatgcagcagttttacgggatcccggtcaccggtgtgttggatcagacaacgatcgagtggatgaagaaaccccgatgtggtgtccctgatcacccccacttaagccgtaggcggagaaacaagcgctatgccctgactggacagaagtggaggcaaaaacacatcacctacagcattcacaactataccccaaaagtgggtgagctagacacgcggaaagctattcgccaggctttcgatgtgtggcagaaggtgaccccactgacctttgaagaggtgccataccatgagatcaaaagtgaccggaaggaggcagacatcatgatcttttttgcttctggtttccatggcgacagctccccatttgatggagaagggggattcctggcccatgcctacttccctggcccagggattggaggagacacccactttgactccgatgagccatggacgctaggaaatgccaaccatgacgggaacgacctcttcctggtggctgtgcatgagctgggccacgcgctgggactggagcactccagcgaccccagcgccatcatggcgcccttctaccagtacatggagacgcacaacttcaagctgccccaggacgatctccagggcatccagaagatctatggacccccagccgagcctctggagcccacaaggccactccctacactccccgtccgcaggatccactcaccatcggagaggaaacacgagcgccagcccaggccccctcggccgcccctcggggaccggccatccacaccaggcaccaaacccaacatctgtgacggcaacttcaacacagtggccctcttccggggcgagatgtttgtctttaaggatcgctggttctggcgtctgcgcaataaccgagtgcaggagggctaccccatgcagatcgagcagttctggaagggcctgcctgcccgcatcgacgcagcctatgaaagggccgatgggagatttgtcttcttcaaaggtgacaagtattgggtgtttaaggaggtgacggtggagcctgggtacccccacagcctgggggagctgggcagctgtttgccccgtgaaggcattgacacagctctgcgctgggaacctgtgggcaagacctactttttcaaaggcgagcggtactggcgctacagcgaggagcggcgggccacggaccctggctaccctaagcccatcaccgtgtggaagggcatcccacaggctccccaaggagccttcatcagcaaggaaggatattacacctatttctacaagggccgggactactggaagtttgacaaccagaaactgagcgtggagccaggctacccgcgcaacatcctgcgtgactggatgggctgcaaccagaaggaggtggagcggcggaaggagcggcggctgccccaggacgacgtggacatcatggtgaccatcaacgatgtgccgggctccgtgaacgccgtggccgtggtcatcccctgcatcctgtccctctgcatcctggtgctggtctacaccatcttccagttcaagaacaagacaggccctcagcctgtcacctactataagcggccagtccaggaatgggtgtgagcagcccagagccctctctatccacttggtctggccagccaggcccttcctcaccagggtctgaggggcagctctggccagtgctcaccagggccagcagggccctaggctggggtcgtacagctgaagtggtgggtgcattggcctaggctgagcgtggggcagggaattatgggggctgtgccccagggtgggtgtctggcacccagctgccagccttctgtcctgggcaaactactccctacttaagggaataggccaggctccatccggaggcagggaccatgccaggaggagcccctgtggtcacggcatcctgtggtgtccatgaggtaccacagctccactcctggctggaacccagcaccctctgtgggaagccagcactagctctcatcccccatccgggagataccaccagtcctggtccccttttgccaacacctgctggtcagatgtccccctacccccaccccactgtcctccaaggctacaggacccctgcttctgacacagtgagcaacaagcctgggtttccctgctggcagacggcagatccctcaggaaacctgctccacttgtcagggtctcttcggagacccaggatttagggtcacatgctgcaggcagggctgtggcccagctgggtctgacaaggacccagctgtcacatcgtgaatatttaaatgtcctgtcactactgtcccattttgcaaaggctgcttgaggctttaggtgaactagaggtgactgtcttggtgatgaggccagcatagcggccctcccccaggcgacaaggaccaaggtgctgctaaggccactctagcgcccagacaccccagtagctgagctctgctcctatggctacagagctggggcagaagctgaccccatttctggaggaagatccgagtttgtgaccgtcctccactcccctctattgtcactgtccccagctttgctccagtctgtcacttgcagcctggagctcagcctcaccagttaggtgaggcagagatggctgcagggccaacactggcagagcctgggagtccttcggaaggggaccagggcgtctgaagtgctcagtgcccccactactctgaggccgactccagctactctgaggccgactcaatctctcggctggaagcagtgttttcccagagcttggcccttgctgacctcgctcactgggcccatcttcccacactgctcttagaaggacacccctaccggtagcagccccaagctgagggggctccctttttgaccttcactggcccgcccttcactgtctccagcaggagttcctagggcttggcctgccttgctccacagtacggcggaggcagccctgcttgtcactgaggagccctagacaaggccaatgggttcatcaatgcccactggctctctgccaaagccaaaaaggtgtcaggcagtctccagcgtgctggccgggtctcggatgccacccctgctcactgagcctgcatgggccttgcccccgaccctgtggtctctgggattggggtcggcttaccctgtagcacagacagggactcctgctgccctgggagctgtctcaagcaaaatctcttgtcccagaggtgcccatgtgggtccgctgtgtcccctgtcatcatccttgttttttctcattttggccaagggcaggctccctgggacaggcagggaacaactgcggagatattagtgattcataggtttgtacagtgttttatactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccattggctcctggcaggccagctgagaatgaacaggagatggaggcaggcagcccaggctgcagaggtgagggatgtggggccaggcccagagggctcagcctagaggcttccaatctcagattctcctgcctgtggtcatctgtttgtccatcaccccaggacagggcagacagaggggcaaagcactgggggccccagagcctagcttcccctcagcctgggggacatcacagcatttcagtgtcagtcacattttaaactgatcagcctttgtataatgttttttaaatcatttctaaataaaacagaaatacaga

SEQ ID NO: 287608 - DNA, 5190 bp, Homo sapiens
gggatgccgaggagccggggcggccgcgccgcgccggggccgccgccgccgccgccgccgccgggccaggccccgcgctggagccgctggcgggtccctgggcggctgctgctgctgctgctgcccgcgctctgctgcctcccgggcgccgcgcgggcggcggcggcggcggcgggggcagggaaccgggcagcggtggcggtggcggtggcgcgggcggacgaggcggaggcgcccttcgccgggcagaactggttaaagtcctatggctatctgcttccctatgactcacgggcatctgcgctgcactcagcgaaggccttgcagtcggcagtctccactatgcagcagttttacgggatcccggtcaccggtgtgttggatcagacaacgatcgagtggatgaagaaaccccgatgtggtgtccctgatcacccccacttaagccgtaggcggagaaacaagcgctatgccctgactggacagaagtggaggcaaaaacacatcacctacagcattcacaactataccccaaaagtgggtgagctagacacgcggaaagctattcgccaggctttcgatgtgtggcagaaggtgaccccactgacctttgaagaggtgccataccatgagatcaaaagtgaccggaaggaggcagacatcatgatcttttttgcttctggtttccatggcgacagctccccatttgatggagaagggggattcctggcccatgcctacttccctggcccagggattggaggagacacccactttgactccgatgagccatggacgctaggaaatgccaaccatgacgggaacgacctcttcctggtggctgtgcatgagctgggccacgcgctgggactggagcactccagcgaccccagcgccatcatggcgcccttctaccagtacatggagacgcacaacttcaagctgccccaggacgatctccagggcatccagaagatctatggacccccagccgagcctctggagcccacaaggccactccctacactccccgtccgcaggatccactcaccatcggagaggaaacacgagcgccagcccaggccccctcggccgcccctcggggaccggccatccacaccaggcaccaaacccaacatctgtgacggcaacttcaacacagtggccctcttccggggcgagatgtttgtctttaaggatcgctggttctggcgtctgcgcaataaccgagtgcaggagggctaccccatgcagatcgagcagttctggaagggcctgcctgcccgcatcgacgcagcctatgaaagggccgatgggagatttgtcttcttcaaaggtgacaagtattgggtgtttaaggaggtgacggtggagcctgggtacccccacagcctgggggagctgggcagctgtttgccccgtgaaggcattgacacagctctgcgctgggaacctgtgggcaagacctactttttcaaaggcgagcggtactggcgctacagcgaggagcggcgggccacggaccctggctaccctaagcccatcaccgtgtggaagggcatcccacaggctccccaaggagccttcatcagcaaggaaggatattacacctatttctacaagggccgggactactggaagtttgacaaccagaaactgagcgtggagccaggctacccgcgcaacatcctgcgtgactggatgggctgcaaccagaaggaggtggagcggcggaaggagcggcggctgccccaggacgacgtggacatcatggtgaccatcaacgatgtgccgggctccgtgaacgccgtggccgtggtcatcccctgcatcctgtccctctgcatcctggtgctggtctacaccatcttccagttcaagaacaagacaggccctcagcctgtcacctactataagcggccagtccaggaatgggtgtgagcagcccagagccctctctatccacttggtctggccagccaggcccttcctcaccagggtctgaggggcagctctggccagtgctcaccagggccagcagggccctaggctggggtcgtacagctgaagtggtgggtgcattggcctaggctgagcgtggggcagggaattatgggggctgtgccccagggtgggtgtctggcacccagctgccagccttctgtcctgggcaaactactccctacttaagggaataggccaggctccatccggaggcagggaccatgccaggaggagcccctgtggtcacggcatcctgtggtgtccatgaggtaccacagctccactcctggctggaacccagcaccctctgtgggaagccagcactagctctcatcccccatccgggagataccaccagtcctggtccccttttgccaacacctgctggtcagatgtccccctacccccaccccactgtcctccaaggctacaggacccctgcttctgacacagtgagcaacaagcctgggtttccctgctggcagacggcagatccctcaggaaacctgctccacttgtcagggtctcttcggagacccaggatttagggtcacatgctgcaggcagggctgtggcccagctgggtctgacaaggacccagctgtcacatcgtgaatatttaaatgtcctgtcactactgtcccattttgcaaaggctgcttgaggctttaggtgaactagaggtgactgtcttggtgatgaggccagcatagcggccctcccccaggcgacaaggaccaaggtgctgctaaggccactctagcgcccagacaccccagtagctgagctctgctcctatggctacagagctggggcagaagctgaccccatttctggaggaagatccgagtttgtgaccgtcctccactcccctctattgtcactgtccccagctttgctccagtctgtcacttgcagcctggagctcagcctcaccagttaggtgaggcagagatggctgcagggccaacactggcagagcctgggagtccttcggaaggggaccagggcgtctgaagtgctcagtgcccccactactctgaggccgactccagctactctgaggccgactcaatctctcggctggaagcagtgttttcccagagcttggcccttgctgacctcgctcactgggcccatcttcccacactgctcttagaaggacacccctaccggtagcagccccaagctgagggggctccctttttgaccttcactggcccgcccttcactgtctccagcaggagttcctagggcttggcctgccttgctccacagtacggcggaggcagccctgcttgtcactgaggagccctagacaaggccaatgggttcatcaatgcccactggctctctgccaaagccaaaaaggtgtcaggcagtctccagcgtgctggccgggtctcggatgccacccctgctcactgagcctgcatgggccttgcccccgaccctgtggtctctgggattggggtcggcttaccctgtagcacagacagggactcctgctgccctgggagctgtctcaagcaaaatctcttgtcccagaggtgcccatgtgggtccgctgtgtcccctgtcatcatccttgttttttctcattttggccaagggcaggctccctgggacaggcagggaacaactgcggagatattagtgattcataggtttgtacagtgttttatactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccattggctcctggcaggccagctgagaatgaacaggagatggaggcaggcagcccaggctgcagaggtgagggatgtggggccaggcccagagggctcagcctagaggcttccaatctcagattctcctgcctgtggtcatctgtttgtccatcaccccaggacagggcagacagaggggcaaagcactgggggccccagagcctagcttcccctcagcctgggggacatcacagcatttcagtgtcagtcacattttaaactgatcagcctttgtataatgttttttaaatcatttctaaataaaacagaaatacagagtgagtgtgtcatttccctgggatgagggaacaaagatcaggttccaagagtaaccttaggacgctctgggaagagaaccgggtcctttggggtgtctgggagctgcccacccatctcctctgccagaccggcggtcagatagcctccctctacaacaggctggccctgggggcccagggttattggggttccaggaacacagcctgatgatgcctccttacgatccaggatggagagcagcccccccaggagtatggggagggtcactgtggcacgggcttctccatgacctgggacatgacctgggacacatagtcaagagcacggttatcagcaatacagatattaataaaaggcagacgaagtcaggaggtcagcaactttgcgggcttaccaggaggcctgtcctgcctctggaagccagcgacagagagggatgcccccgacccagccagccggagaaagggatggggtggtcacgaaggtctgagctgggtctgggtgtaggctgggaagcaggctggggtgtagactgcgaaggcggccctgccgggacttctttccagtccccggcgacctcttcgaattctctgctatctctggggagcctcgggtgggagggggtgtaagagacgcagggacgtggggagaggagacaaggcaggcaagaaccacaggggacggcggacagacgggcgacatcctgcggaggacgccgtcagtaccaggaagtgcaggcgatgaggaagcgcacgtcgtccagcggcccccacgggctgggctcgggctggggctggggctggggctggggctggggctggggctgggtttgcgcaggctccggggcgccgcggccgct

SEQ ID NO: 287609 - DNA, 4456 bp, Homo sapiens
gggatgccgaggagccggggcggccgcgccgcgccggggccgccgccgccgccgccgccgccgggccaggccccgcgctggagccgctggcgggtccctgggcggctgctgctgctgctgctgcccgcgctctgctgcctcccgggcgccgcgcgggcggcggcggcggcggcgggggcagggaaccgggcagcggtggcggtggcggtggcgcgggcggacgaggcggaggcgcccttcgccgggcagaactggttaaagtcctatggctatctgcttccctatgactcacgggcatctgcgctgcactcagcgaaggccttgcagtcggcagtctccactatgcagcagttttacgggatcccggtcaccggtgtgttggatcagacaacgatcgagtggatgaagaaaccccgatgtggtgtccctgatcacccccacttaagccgtaggcggagaaacaagcgctatgccctgactggacagaagtggaggcaaaaacacatcacctacagcattcacaactataccccaaaagtgggtgagctagacacgcggaaagctattcgccaggctttcgatgtgtggcagaaggtgaccccactgacctttgaagaggtgccataccatgagatcaaaagtgaccggaaggaggcagacatcatgatcttttttgcttctggtttccatggcgacagctccccatttgatggagaagggggattcctggcccatgcctacttccctggcccagggattggaggagacacccactttgactccgatgagccatggacgctaggaaatgccaaccatgacgggaacgacctcttcctggtggctgtgcatgagctgggccacgcgctgggactggagcactccagcgaccccagcgccatcatggcgcccttctaccagtacatggagacgcacaacttcaagctgccccaggacgatctccagggcatccagaagatctatggacccccagccgagcctctggagcccacaaggccactccctacactccccgtccgcaggatccactcaccatcggagaggaaacacgagcgccagcccaggccccctcggccgcccctcggggaccggccatccacaccaggcaccaaacccaacatctgtgacggcaacttcaacacagtggccctcttccggggcgagatgtttgtctttaaggatcgctggttctggcgtctgcgcaataaccgagtgcaggagggctaccccatgcagatcgagcagttctggaagggcctgcctgcccgcatcgacgcagcctatgaaagggccgatgggagatttgtcttcttcaaaggtgacaagtattgggtgtttaaggaggtgacggtggagcctgggtacccccacagcctgggggagctgggcagctgtttgccccgtgaaggcattgacacagctctgcgctgggaacctgtgggcaagacctactttttcaaaggcgagcggtactggcgctacagcgaggagcggcgggccacggaccctggctaccctaagcccatcaccgtgtggaagggcatcccacaggctccccaaggagccttcatcagcaaggaaggatattacacctatttctacaagggccgggactactggaagtttgacaaccagaaactgagcgtggagccaggctacccgcgcaacatcctgcgtgactggatgggctgcaaccagaaggaggtggagcggcggaaggagcggcggctgccccaggacgacgtggacatcatggtgaccatcaacgatgtgccgggctccgtgaacgccgtggccgtggtcatcccctgcatcctgtccctctgcatcctggtgctggtctacaccatcttccagttcaagaacaagacaggccctcagcctgtcacctactataagcggccagtccaggaatgggtgtgagcagcccagagccctctctatccacttggtctggccagccaggcccttcctcaccagggtctgaggggcagctctggccagtgctcaccagggccagcagggccctaggctggggtcgtacagctgaagtggtgggtgcattggcctaggctgagcgtggggcagggaattatgggggctgtgccccagggtgggtgtctggcacccagctgccagccttctgtcctgggcaaactactccctacttaagggaataggccaggctccatccggaggcagggaccatgccaggaggagcccctgtggtcacggcatcctgtggtgtccatgaggtaccacagctccactcctggctggaacccagcaccctctgtgggaagccagcactagctctcatcccccatccgggagataccaccagtcctggtccccttttgccaacacctgctggtcagatgtccccctacccccaccccactgtcctccaaggctacaggacccctgcttctgacacagtgagcaacaagcctgggtttccctgctggcagacggcagatccctcaggaaacctgctccacttgtcagggtctcttcggagacccaggatttagggtcacatgctgcaggcagggctgtggcccagctgggtctgacaaggacccagctgtcacatcgtgaatatttaaatgtcctgtcactactgtcccattttgcaaaggctgcttgaggctttaggtgaactagaggtgactgtcttggtgatgaggccagcatagcggccctcccccaggcgacaaggaccaaggtgctgctaaggccactctagcgcccagacaccccagtagctgagctctgctcctatggctacagagctggggcagaagctgaccccatttctggaggaagatccgagtttgtgaccgtcctccactcccctctattgtcactgtccccagctttgctccagtctgtcacttgcagcctggagctcagcctcaccagttaggtgaggcagagatggctgcagggccaacactggcagagcctgggagtccttcggaaggggaccagggcgtctgaagtgctcagtgcccccactactctgaggccgactccagctactctgaggccgactcaatctctcggctggaagcagtgttttcccagagcttggcccttgctgacctcgctcactgggcccatcttcccacactgctcttagaaggacacccctaccggtagcagccccaagctgagggggctccctttttgaccttcactggcccgcccttcactgtctccagcaggagttcctagggcttggcctgccttgctccacagtacggcggaggcagccctgcttgtcactgaggagccctagacaaggccaatgggttcatcaatgcccactggctctctgccaaagccaaaaaggtgtcaggcagtctccagcgtgctggccgggtctcggatgccacccctgctcactgagcctgcatgggccttgcccccgaccctgtggtctctgggattggggtcggcttaccctgtagcacagacagggactcctgctgccctgggagctgtctcaagcaaaatctcttgtcccagaggtgcccatgtgggtccgctgtgtcccctgtcatcatccttgttttttctcattttggccaagggcaggctccctgggacaggcagggaacaactgcggagatattagtgattcataggtttgtacagtgttttatactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccattggctcctggcaggccagctgagaatgaacaggagatggaggcaggctggggtgtagactgcgaaggcggccctgccgggacttctttccagtccccggcgacctcttcgaattctctgctatctctggggagcctcgggtgggagggggtgtaagagacgcagggacgtggggagaggagacaaggcaggcaagaaccacaggggacggcggacagacgggcgacatcctgcggaggacgccgtcagtaccaggaagtgcaggcgatgaggaagcgcacgtcgtccagcggcccccacgggctgggctcgggctggggctggggctggggctggggctggggctggggcggatgccggggctgttccgggccctccggcgccgcaggctggggctggggctggggctgggtttgcgcaggctccggggcgccgcggccgct

SEQ ID NO: 287610 - DNA, 4865 bp, Homo sapiens
gggatgccgaggagccggggcggccgcgccgcgccggggccgccgccgccgccgccgccgccgggccaggccccgcgctggagccgctggcgggtccctgggcggctgctgctgctgctgctgcccgcgctctgctgcctcccgggcgccgcgcgggcggcggcggcggcggcgggggcagggaaccgggcagcggtggcggtggcggtggcgcgggcggacgaggcggaggcgcccttcgccgggcagaactggttaaagtcctatggctatctgcttccctatgactcacgggcatctgcgctgcactcagcgaaggccttgcagtcggcagtctccactatgcagcagttttacgggatcccggtcaccggtgtgttggatcagacaacgatcgagtggatgaagaaaccccgatgtggtgtccctgatcacccccacttaagccgtaggcggagaaacaagcgctatgccctgactggacagaagtggaggcaaaaacacatcacctacagcattcacaactataccccaaaagtgggtgagctagacacgcggaaagctattcgccaggctttcgatgtgtggcagaaggtgaccccactgacctttgaagaggtgccataccatgagatcaaaagtgaccggaaggaggcagacatcatgatcttttttgcttctggtttccatggcgacagctccccatttgatggagaagggggattcctggcccatgcctacttccctggcccagggattggaggagacacccactttgactccgatgagccatggacgctaggaaatgccaaccatgacgggaacgacctcttcctggtggctgtgcatgagctgggccacgcgctgggactggagcactccagcgaccccagcgccatcatggcgcccttctaccagtacatggagacgcacaacttcaagctgccccaggacgatctccagggcatccagaagatctatggacccccagccgagcctctggagcccacaaggccactccctacactccccgtccgcaggatccactcaccatcggagaggaaacacgagcgccagcccaggccccctcggccgcccctcggggaccggccatccacaccaggcaccaaacccaacatctgtgacggcaacttcaacacagtggccctcttccggggcgagatgtttgtctttaaggatcgctggttctggcgtctgcgcaataaccgagtgcaggagggctaccccatgcagatcgagcagttctggaagggcctgcctgcccgcatcgacgcagcctatgaaagggccgatgggagatttgtcttcttcaaaggtgacaagtattgggtgtttaaggaggtgacggtggagcctgggtacccccacagcctgggggagctgggcagctgtttgccccgtgaaggcattgacacagctctgcgctgggaacctgtgggcaagacctactttttcaaaggcgagcggtactggcgctacagcgaggagcggcgggccacggaccctggctaccctaagcccatcaccgtgtggaagggcatcccacaggctccccaaggagccttcatcagcaaggaaggatattacacctatttctacaagggccgggactactggaagtttgacaaccagaaactgagcgtggagccaggctacccgcgcaacatcctgcgtgactggatgggctgcaaccagaaggaggtggagcggcggaaggagcggcggctgccccaggacgacgtggacatcatggtgaccatcaacgatgtgccgggctccgtgaacgccgtggccgtggtcatcccctgcatcctgtccctctgcatcctggtgctggtctacaccatcttccagttcaagaacaagacaggccctcagcctgtcacctactataagcggccagtccaggaatgggtgtgagcagcccagagccctctctatccacttggtctggccagccaggcccttcctcaccagggtctgaggggcagctctggccagtgctcaccagggccagcagggccctaggctggggtcgtacagctgaagtggtgggtgcattggcctaggctgagcgtggggcagggaattatgggggctgtgccccagggtgggtgtctggcacccagctgccagccttctgtcctgggcaaactactccctacttaagggaataggccaggctccatccggaggcagggaccatgccaggaggagcccctgtggtcacggcatcctgtggtgtccatgaggtaccacagctccactcctggctggaacccagcaccctctgtgggaagccagcactagctctcatcccccatccgggagataccaccagtcctggtccccttttgccaacacctgctggtcagatgtccccctacccccaccccactgtcctccaaggctacaggacccctgcttctgacacagtgagcaacaagcctgggtttccctgctggcagacggcagatccctcaggaaacctgctccacttgtcagggtctcttcggagacccaggatttagggtcacatgctgcaggcagggctgtggcccagctgggtctgacaaggacccagctgtcacatcgtgaatatttaaatgtcctgtcactactgtcccattttgcaaaggctgcttgaggctttaggtgaactagaggtgactgtcttggtgatgaggccagcatagcggccctcccccaggcgacaaggaccaaggtgctgctaaggccactctagcgcccagacaccccagtagctgagctctgctcctatggctacagagctggggcagaagctgaccccatttctggaggaagatccgagtttgtgaccgtcctccactcccctctattgtcactgtccccagctttgctccagtctgtcacttgcagcctggagctcagcctcaccagttaggtgaggcagagatggctgcagggccaacactggcagagcctgggagtccttcggaaggggaccagggcgtctgaagtgctcagtgcccccactactctgaggccgactccagctactctgaggccgactcaatctctcggctggaagcagtgttttcccagagcttggcccttgctgacctcgctcactgggcccatcttcccacactgctcttagaaggacacccctaccggtagcagccccaagctgagggggctccctttttgaccttcactggcccgcccttcactgtctccagcaggagttcctagggcttggcctgccttgctccacagtacggcggaggcagccctgcttgtcactgaggagccctagacaaggccaatgggttcatcaatgcccactggctctctgccaaagccaaaaaggtgtcaggcagtctccagcgtgctggccgggtctcggatgccacccctgctcactgagcctgcatgggccttgcccccgaccctgtggtctctgggattggggtcggcttaccctgtagcacagacagggactcctgctgccctgggagctgtctcaagcaaaatctcttgtcccagaggtgcccatgtgggtccgctgtgtcccctgtcatcatccttgttttttctcattttggccaagggcaggctccctgggacaggcagggaacaactgcggagatattagtgattcataggtttgtacagtgttttatactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccattggctcctggcaggccagctgagaatgaacaggagatggaggcaggcagcccaggctgcagaggtgagggatgtggggccaggcccagagggctcagcctagaggcttccaatctcagattctcctgcctgtggtcatctgtttgtccatcaccccaggacagggcagacagaggggcaaagcactgggggccccagagcctagcttcccctcagcctgggggacatcacagcatttcagtgtcagtcacattttaaactgatcagcctttgtataatgttttttaaatcatttctaaataaaacagaaatacagagtgagtgtgtcatttccctgggatgagggaacaaagatcaggttccaagagtaaccttaggacgctctgggaagagaaccgggtcctttggggtgtctgggagctgcccacccatctcctctgccagaccggcggtcagatagcctccctctacaacaggctggccctgggggcccagggttattggggttccaggaacacagcctgatgatgcctccttacgatccaggatggagagcagcccccccaggagtatggggagggtcactgtggcacgggcttctccatgacctgggacatgacctgggacacatagtcaagagcacggttatcagcaatacagatattaataaaaggcagacgaagtcaggaggtcagcaactttgcgggcttaccaggaggcctgtcctgcctctggaagccagcgacagagagggatgcccccgacccagccagccggagaaagggatggggtggtcacggcgccagctcctcccgacgccgagaccatgggggctcagctaagcggcggccg

SEQ ID NO: 287611 - DNA, 4300 bp, Homo sapiens
gggatgccgaggagccggggcggccgcgccgcgccggggccgccgccgccgccgccgccgccgggccaggccccgcgctggagccgctggcgggtccctgggcggctgctgctgctgctgctgcccgcgctctgctgcctcccgggcgccgcgcgggcggcggcggcggcggcgggggcagggaaccgggcagcggtggcggtggcggtggcgcgggcggacgaggcggaggcgcccttcgccgggcagaactggttaaagtcctatggctatctgcttccctatgactcacgggcatctgcgctgcactcagcgaaggccttgcagtcggcagtctccactatgcagcagttttacgggatcccggtcaccggtgtgttggatcagacaacgatcgagtggatgaagaaaccccgatgtggtgtccctgatcacccccacttaagccgtaggcggagaaacaagcgctatgccctgactggacagaagtggaggcaaaaacacatcacctacagcattcacaactataccccaaaagtgggtgagctagacacgcggaaagctattcgccaggctttcgatgtgtggcagaaggtgaccccactgacctttgaagaggtgccataccatgagatcaaaagtgaccggaaggaggcagacatcatgatcttttttgcttctggtttccatggcgacagctccccatttgatggagaagggggattcctggcccatgcctacttccctggcccagggattggaggagacacccactttgactccgatgagccatggacgctaggaaatgccaaccatgacgggaacgacctcttcctggtggctgtgcatgagctgggccacgcgctgggactggagcactccagcgaccccagcgccatcatggcgcccttctaccagtacatggagacgcacaacttcaagctgccccaggacgatctccagggcatccagaagatctatggacccccagccgagcctctggagcccacaaggccactccctacactccccgtccgcaggatccactcaccatcggagaggaaacacgagcgccagcccaggccccctcggccgcccctcggggaccggccatccacaccaggcaccaaacccaacatctgtgacggcaacttcaacacagtggccctcttccggggcgagatgtttgtctttaaggatcgctggttctggcgtctgcgcaataaccgagtgcaggagggctaccccatgcagatcgagcagttctggaagggcctgcctgcccgcatcgacgcagcctatgaaagggccgatgggagatttgtcttcttcaaaggtgacaagtattgggtgtttaaggaggtgacggtggagcctgggtacccccacagcctgggggagctgggcagctgtttgccccgtgaaggcattgacacagctctgcgctgggaacctgtgggcaagacctactttttcaaaggcgagcggtactggcgctacagcgaggagcggcgggccacggaccctggctaccctaagcccatcaccgtgtggaagggcatcccacaggctccccaaggagccttcatcagcaaggaaggatattacacctatttctacaagggccgggactactggaagtttgacaaccagaaactgagcgtggagccaggctacccgcgcaacatcctgcgtgactggatgggctgcaaccagaaggaggtggagcggcggaaggagcggcggctgccccaggacgacgtggacatcatggtgaccatcaacgatgtgccgggctccgtgaacgccgtggccgtggtcatcccctgcatcctgtccctctgcatcctggtgctggtctacaccatcttccagttcaagaacaagacaggccctcagcctgtcacctactataagcggccagtccaggaatgggtgtgagcagcccagagccctctctatccacttggtctggccagccaggcccttcctcaccagggtctgaggggcagctctggccagtgctcaccagggccagcagggccctaggctggggtcgtacagctgaagtggtgggtgcattggcctaggctgagcgtggggcagggaattatgggggctgtgccccagggtgggtgtctggcacccagctgccagccttctgtcctgggcaaactactccctacttaagggaataggccaggctccatccggaggcagggaccatgccaggaggagcccctgtggtcacggcatcctgtggtgtccatgaggtaccacagctccactcctggctggaacccagcaccctctgtgggaagccagcactagctctcatcccccatccgggagataccaccagtcctggtccccttttgccaacacctgctggtcagatgtccccctacccccaccccactgtcctccaaggctacaggacccctgcttctgacacagtgagcaacaagcctgggtttccctgctggcagacggcagatccctcaggaaacctgctccacttgtcagggtctcttcggagacccaggatttagggtcacatgctgcaggcagggctgtggcccagctgggtctgacaaggacccagctgtcacatcgtgaatatttaaatgtcctgtcactactgtcccattttgcaaaggctgcttgaggctttaggtgaactagaggtgactgtcttggtgatgaggccagcatagcggccctcccccaggcgacaaggaccaaggtgctgctaaggccactctagcgcccagacaccccagtagctgagctctgctcctatggctacagagctggggcagaagctgaccccatttctggaggaagatccgagtttgtgaccgtcctccactcccctctattgtcactgtccccagctttgctccagtctgtcacttgcagcctggagctcagcctcaccagttaggtgaggcagagatggctgcagggccaacactggcagagcctgggagtccttcggaaggggaccagggcgtctgaagtgctcagtgcccccactactctgaggccgactccagctactctgaggccgactcaatctctcggctggaagcagtgttttcccagagcttggcccttgctgacctcgctcactgggcccatcttcccacactgctcttagaaggacacccctaccggtagcagccccaagctgagggggctccctttttgaccttcactggcccgcccttcactgtctccagcaggagttcctagggcttggcctgccttgctccacagtacggcggaggcagccctgcttgtcactgaggagccctagacaaggccaatgggttcatcaatgcccactggctctctgccaaagccaaaaaggtgtcaggcagtctccagcgtgctggccgggtctcggatgccacccctgctcactgagcctgcatgggccttgcccccgaccctgtggtctctgggattggggtcggcttaccctgtagcacagacagggactcctgctgccctgggagctgtctcaagcaaaatctcttgtcccagaggtgcccatgtgggtccgctgtgtcccctgtcatcatccttgttttttctcattttggccaagggcaggctccctgggacaggcagggaacaactgcggagatattagtgattcataggtttgtacagtgttttatactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccattggctcctggcaggccagctgagaatgaacaggagatggaggcaggcagcccaggctgcagaggtgagggatgtggggccaggcccagagggctcagcctagaggcttccaatctcagattctcctgcctgtggtcatctgtttgtccatcaccccaggacagggcagacagaggggcaaagcactgggggggacatcacagcatttcagtgtcagtcacattttaaactgatcagcctttgtataatgttttttaaatcatttctaaataaaacagaaatacaga

SEQ ID NO: 287612 - DNA, 1685 bp, Homo sapiens
gagagagagagagagagagagagagagagagagagagagagagagagagagagagagagagagacaaaatctcttgtcccagaggtgcccatgtgggtccgctgtgtcccctgtcatcatccttgttttttctcattttggccaagggcaggctccctgggacaggcagggaacaactgcggagatattagtgattcataggtttgtacagtgttttatactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccattggctcctggcaggccagctgagaatgaacaggagatggaggcaggcagcccaggctgcagaggtgagggatgtggggccaggcccagagggctcagcctagaggcttccaatctcagattctcctgcctgtggtcatctgtttgtccatcaccccaggacagggcagacagaggggcaaagcactgggggccccagagcctagcttcccctcagcctgggggacatcacagcatttcagtgtcagtcacattttaaactgatcagcctttgtataatgttttttaaatcatttctaaataaaacagaaatacagagtgagtgtgtcatttccctgggatgagggaacaaagatcaggttccaagagtaaccttaggacgctctgggaagagaaccgggtcctttggggtgtctgggagctgcccacccatctcctctgccagaccggcggtcagatagcctccctctacaacaggctggccctgggggcccagggttattggggttccaggaacacagcctgatgatgcctccttacgatccaggatggagagcagcccccccaggagtatggggagggtcactgtggcacgggcttctccatgacctgggacatgaccaggaggcctgtcctgcctctggaagccagcgacagagagggatgcccccgacccagccagccggagaaagggatggggtggtcacgaaggtctgagctgggtctgggtgtaggctgggaagcaggctggggtgtagactgcgaaggcggccctgccgggacttctttccagtccccggcgacctcttcgaattctctgctatctctggggagcctcgggtgggagggggtgtaagagacgcagggacgtggggagaggagacaaggcaggcaagaaccacaggggacggcggacagacgggcgacatcctgcggaggacgccgtcagtaccaggaagtgcaggcgatgaggaagcgcacgtcgtccagcggcccccacgggctgggctcgggctggggctggggctggggctggggctggggctggggcggatgccggggctgttccgggccctccggcgccgcaggctggggctggggctggggctgggtttgcgcaggctccggggcgccgcggccgct

SEQ ID NO: 287613 - DNA, 897 bp, Homo sapiens
ttttaaaactaagctgggtggccaacccagggacaccgtgctctgctaaatgatgactccagctacatttcccgaggccaagagatgagaagctgctggctccaagctccgctgcaggctgccctggctgagcgggtgctaggcaccgcggagcgctgcctggtgctctgaagccatgccccagtgcctccctgggagttctgctgtggagtctgtgtggaggctgactctggagagatgtttgtgtccaggtggctgcctgtggtctggctaagtaaaggggtgagtattcttggtgtcactgtccaaagcaaagttgtgtccatgggacacagactaggtgaggctctgtgtccaggtgatgctgtccagtgagagggggttgcagtcagagtgaggctgaccggaggcctctgtccagttggtgccctgtggaatgtgattacatactggttgacaccatcctgaggaccatcaccatgcgtggagaccctgcctcctcactgagaccttgcaagaaaaagaacctgcagtcaccccaaggaagaggagtctcggctgttccctggaggctgacccagccctggcccaaaggctgacccagacccaaggcccaaaggcccacccagacccaaggcccaaaggcccagctctaaggtccaaaggggctccaccctgttctctagccggactcagtctctggcaaggaccccggctgccagctgcactccctagacgcacgtggcccaccccctccttccagtaccggagccctaactggcggcacccgggcacccttttgactcagagccacgctccacgagggggaccgatctgctcacttgccccgtcctgggggtaccagagtagccagcgcgacgccttccgcacctcgcc

SEQ ID NO: 287614 - DNA, 505 bp, Homo sapiens
aagagatgagaagctgctggctccaagctccgctgcaggctgccctggctgagcgggtgctaggcaccgcggagcgctgcctggtgctctgaagccatgccccagtgcctccctgggagttctgctgtggagtctgtgtggaggctgactctggagagatgtttgtgtccaggtggctgcctgtggtctggctaagtaaaggggtgagtattcttggtgtcactgtccaaagcaaagttgtgtccatgggacacagactaggtgaggctctgtgtccaggtgatgctgtccagtgagagggggttgcagtcagagtgaggctgaccggaggcctctgtccagttggtgccctgtggaatgtgattacatactggttgacaccatcctgaggaccatcaccagctgagtgtctcagccgccctgtgtccctgggttctgtgctcttgtgtgtggtttgacactattccagtgcgtggagaccctgcctcctcactgagaccttgca

SEQ ID NO: 287615 - DNA, 417 bp, Homo sapiens
ctcccagccaaggataatcctaatccctgacttcagcttcttgctatctacaccatctgtaaaggttacctatccttagacatgttagaaaccatatcagtaaccatatgatatttaaaatcttgagatcaattgtgtcgagtaaaacaaattaaatcatgccagataaaaattatgaatttttccataaaagcatcatcttcaggaaggacctcaggatccttcctgaggatggtataacttcgcgggagccctcccagaaagactcctgtgttatctccaataacagtactaccattcaggatggcagaggaacctagagaagaggagatgagaaatacaccttcaccaggatactctagttttactagctcagcaaataataaaatccttcaccagcctttgggataccactct

SEQ ID NO: 287616 - DNA, 407 bp, Homo sapiens
cattttagccattgacagatgtattttcaaaccaaggcatgctctgtcagaagactacaaaaatattactgcttcaggaaaccatatcagtaaccatatgatatttaaaatcttgagatcaattgtgtcgagtaaaacaaattaaatcatgccagataaaaattatgaatttttccataaaagcatcatcttcaggaaggacctcaggatccttcctgaggatggtataacttcgcgggagccctcccagaaagactcctgtgttatctccaataacagtactaccattcaggatggcagaggaacctagagaagaggagatgagaaatacaccttcaccaggatactctagttttactagctcagcaaataataaaatccttcaccagcctttgggataccactct

SEQ ID NO: 287617 - DNA, 288 bp, Homo sapiens
ctcccagccaaggataatcctaatccctgacttcagcttcttgctatctacaccatctgtaaaggttacctatccttagacatgttaggatccttcctgaggatggtataacttcgcgggagccctcccagaaagactcctgtgttatctccaataacagtactaccattcaggatggcagaggaacctagagaagaggagatgagaaatacaccttcaccaggatactctagttttactagctcagcaaataataaaatccttcaccagcctttgggataccactct

SEQ ID NO: 287618 - DNA, 494 bp, Homo sapiens
ctcccagccaaggataatcctaatccctgacttcagcttcttgctatctacaccatctgtaaaggttacctatccttagacatgttagaaaccatatcagtaaccatatgatatttaaaatcttgagatcaattgtgtcgagtaaaacaaattaaatcatgccagataaaaattatgaatttttccataaaagcatcatcttcaggaaggacctcaggagggtgttctgccatcatcacgttatgaaaagcatttgaaagaaatgctgactgttgttgttgacaaggaggaggggatccttcctgaggatggtataacttcgcgggagccctcccagaaagactcctgtgttatctccaataacagtactaccattcaggatggcagaggaacctagagaagaggagatgagaaatacaccttcaccaggatactctagttttactagctcagcaaataataaaatccttcaccagcctttgggataccactct

SEQ ID NO: 287619 - DNA, 436 bp, Homo sapiens
cattttagccattgacagatgtattttcaaaccaaggcatgctctgtcagaagactacaaaaatattactgcttcagggtaatagtccttccttttatataaatgcacaaatacatgcatgtgtgtgtgtgcacatatgcatttgaagataagtatttacctgctcctgttgtacgtcctcgactccaatcactatatactgaacctccttcatgcgaggctatcactcgatacaggatccttcctgaggatggtataacttcgcgggagccctcccagaaagactcctgtgttatctccaataacagtactaccattcaggatggcagaggaacctagagaagaggagatgagaaatacaccttcaccaggatactctagttttactagctcagcaaataataaaatccttcaccagcctttgggataccactct

SEQ ID NO: 287620 - DNA, 448 bp, Homo sapiens
ctcccagccaaggataatcctaatccctgacttcagcttcttgctatctacaccatctgtaaaggttacctatccttagacatgttagaaaccatatcagtaaccatatgatatttaaaatcttgagatcaattgtgtcgagtaaaacaaattaaatcatgccagataaaaattatgaatttttccataaaagcatcatcttcaggaaggacctcaggatccttcctgaggatggtataacttcgcgggagccctcccagaaagactcctgtgttatctccaataacagtactaccattcaggatggcagaggaacctgtatatatcccatccagagtgatttggccaaaagcctgatgcctaatagcaattatttcatgccattttccatcactatattgtttgccatgatcattagttgtagttacttccactggtgaccccttaa

SEQ ID NO: 287621 - DNA, 420 bp, Homo sapiens
  misc_feature (420)..(420): n is a, c, g, or t
ccacccgctctcttcccatccaggctgcaacccacgcttcgagggccttgcgcattgcagaggacacggcagcctgctcatcacgctcaactacacctcctgcaagagctttggccaccttgggaggcaggatctagatatctccccacaaacctaaacaatttcgagagggacttgtgttctgcaaccagtcacagaatatcaggtgagctgggcgtgtcttcactgacccacccgcccagggactggtcgagtgtcatgtgcgccatggtcatgcatcatagggaagagactcgggtacggggctcacccgcctctaagatgagactggtatacagataacgcatgcaatgatggtcactataggaggtctcatatcatccagttataaatgattaaggctcagatgctgtcctgaan

SEQ ID NO: 287622 - DNA, 2294 bp, Homo sapiens
tttcactctttttcccccctgtatattccttcttttttttttttttcagggtccaagcctcggcatgtgctggcttgtttggctttattttagaaaccaaccaacatgtttcattagcactgacacagcaggggtcccctgctgccacctgacaatccagcgtcacttacactgcacccacgcaggccacaccttcaatggccacggcacgctagcccagagttagccacacagaaacacacttctcaccgcacaaaactcccttttgaaaaaaccaagcaatcgtcaggtcggaggagaatcactagccccccacagcgagaggggacaaagcttggtggccgaggcccaggtccttgtggcccctcccggtggggtgaaggtgcccgggactcctcggggttgcatggctacagccggggcgctgccagggcctcctctgcggctgagagatggaagggatccttcccgacgcccgcaggtgggggcgagccaccgggaaccgggcctgtcaccagcatccccgagcccccgcagaccggaatgcaaatggctccgcgcccacgcggctcccggtctgctgacgagggctgcctgctcccatttcttctcttcctcttcattttttttaagggctgccagttctggaaactttttctggcttctcagacaactgtggcaagatggagtagagagaggccccggccgggcgctttctgctgcctcgcggaggggcgggcacggggagtgaggggtccccaggcccagcgggtgcggggccgggtgaggagacggagctcacccccgttcggaacccagaagcatggcgggtccccacgcgcagcccttcaggggcctcgggagcccgcggcctgggtcacctccggctcccttcaggcggggggcggctgctgccgccaggctcgggcgtgggtgcgggcggtgggcatcccacgggggtaggggaggcgagagcctgaggagactcgggagggggcccgtggacgcggctggcccgggatggagctggcgcggccacagtgggggacgaggcagggcacgcggcgttccccgggctcggcctccctcccagcgcacgggcggtcggaggaactggagcccccaccccggacacggtcccgcgggcgaaggcttctccccgtcgccccggtccggcctccctcccgccgccgccagcagaggccgctgtcccacgcgccgggtcccgttggcgccggggcctcctgggacggcctggccgcggcctgcgggtatgcgctctttccagaaaggcagcacacgcatgtctctgccgtggccccagatcctccccgcgccgccgttttgagcgttcacactcattacccaggtccgtctgggagacccgccgggctcccgccctcccggcccgcagcctcctggccaaaatcctcccgggacaccccacctggactgctgcgaacgggcctccacccgcctccccggacccgcagcgccccccgctccctcagggttctggggtgaaggggtctgaatagcaccaggggaggcggcagggcgggcctgtcctacctgcgcccgagcactgctgagacgacatcccttccagcgccgccacgtagtccagccccagccagccgcggtcctggaagcaccgcaggcagacgacctgctcctcactgggctcaggcagggtcacccgcccagtgccgctagctgcaaattgctttacatacagtgacccaaagagcaagtcatttcagggccccaccactctgattggaagtcataagcttgacaactgattggcctctgtcacccaagcgggtgtggggacactaggcccgcaggtgccactggaagaggcgttcagaagcactgcggtgctccagctcctggatgcaggtctgaggcctgagatgtccaggaagaaagacccagaaatgagggatggtgtgggtgggattcctgagcgttctgctaggcctgctgagcacttcttggccttttccataaggctttctcactctgtcttacagatatctccccacaaacctaaacaatttcgagagggacttgtgttctgcaaccagtcacagaatatcaggtgagctgggcgtgtcttcactgacccacccgcccagggatgctgcactcctctccaccctgctcagaatcactagaatgaccgttctgtggctacagccctaaaagagctactaaaaagaccagaagtagtatgagaacttatgaatacgaatataaataaaggacatctggagaacaaaaaaaaa

SEQ ID NO: 287623 - DNA, 2197 bp, Homo sapiens
tttcactctttttcccccctgtatattccttcttttttttttttttcagggtccaagcctcggcatgtgctggcttgtttggctttattttagaaaccaaccaacatgtttcattagcactgacacagcaggggtcccctgctgccacctgacaatccagcgtcacttacactgcacccacgcaggccacaccttcaatggccacggcacgctagcccagagttagccacacagaaacacacttctcaccgcacaaaactcccttttgaaaaaaccaagcaatcgtcaggtcggaggagaatcactagccccccacagcgagaggggacaaagcttggtggccgaggcccaggtccttgtggcccctcccggtggggtgaaggtgcccgggactcctcggggttgcatggctacagccggggcgctgccagggcctcctctgcggctgagagatggaagggatccttcccgacgcccgcaggtgggggcgagccaccgggaaccgggcctgtcaccagcatccccgagcccccgcagaccggaatgcaaatggctccgcgcccacgcggctcccggtctgctgacgagggctgcctgctcccatttcttctcttcctcttcattttttttaagggctgccagttctggaaactttttctggcttctcagacaactgtggcaagatggagtagagagaggccccggccgggcgctttctgctgcctcgcggaggggcgggcacggggagtgaggggtccccaggcccagcgggtgcggggccgggtgaggagacggagctcacccccgttcggaacccagaagcatggcgggtccccacgcgcagcccttcaggggcctcgggagcccgcggcctgggtcacctccggctcccttcaggcggggggcggctgctgccgccaggctcgggcgtgggtgcgggcggtgggcatcccacgggggtaggggaggcgagagcctgaggagactcgggagggggcccgtggacgcggctggcccgggatggagctggcgcggccacagtgggggacgaggcagggcacgcggcgttccccgggctcggcctccctcccagcgcacgggcggtcggaggaactggagcccccaccccggacacggtcccgcgggcgaaggcttctccccgtcgccccggtccggcctccctcccgccgccgccagcagaggccgctgtcccacgcgccgggtcccgttggcgccggggcctcctgggacggcctggccgcggcctgcgggtatgcgctctttccagaaaggcagcacacgcatgtctctgccgtggccccagatcctccccgcgccgccgttttgagcgttcacactcattacccaggtccgtctgggagacccgccgggctcccgccctcccggcccgcagcctcctggccaaaatcctcccgggacaccccacctggactgctgcgaacgggcctccacccgcctccccggacccgcagcgccccccgctccctcagggttctggggtgaaggggtctgaatagcaccaggggaggcggcagggcgggcctgtcctacctgcgcccgagcactgctgagacgacatcccttccagcgccgccacgtagtccagccccagccagccgcggtcctggaagcaccgcaggcagacgacctgctcctcactgggctcaggcagggtcacccgcccagtgccgctagctgcaaattgctttacatacagtgacccaaagagcaagtcatttcagggccccaccactctgattggaagtcataagcttgacaactgattggcctctgtcacccaagcgggtgtggggacactaggcccgcaggtgccactggaagaggcgttcagaagcactgcggtgctccagctcctggatgcagatatctccccacaaacctaaacaatttcgagagggacttgtgttctgcaaccagtcacagaatatcaggtgagctgggcgtgtcttcactgacccacccgcccagggatgctgcactcctctccaccctgctcagaatcactagaatgaccgttctgtggctacagccctaaaagagctactaaaaagaccagaagtagtatgagaacttatgaatacgaatataaataaaggctgtaggcgtgcagctttctaacccatatcttaacagaagtacgccgtgcagggccaag

SEQ ID NO: 287624 - DNA, 1934 bp, Homo sapiens
tttcactctttttcccccctgtatattccttcttttttttttttttcagggtccaagcctcggcatgtgctggcttgtttggctttattttagaaaccaaccaacatgtttcattagcactgacacagcaggggtcccctgctgccacctgacaatccagcgtcacttacactgcacccacgcaggccacaccttcaatggccacggcacgctagcccagagttagccacacagaaacacacttctcaccgcacaaaactcccttttgaaaaaaccaagcaatcgtcaggtcggaggagaatcactagccccccacagcgagaggggacaaagcttggtggccgaggcccaggtccttgtggcccctcccggtggggtgaaggtgcccgggactcctcggggttgcatggctacagccggggcgctgccagggcctcctctgcggctgagagatggaagggatccttcccgacgcccgcaggtgggggcgagccaccgggaaccgggcctgtcaccagcatccccgagcccccgcagaccggaatgcaaatggctccgcgcccacgcggctcccggtctgctgacgagggctgcctgctcccatttcttctcttcctcttcattttttttaagggctgccagttctggaaactttttctggcttctcagacaactgtggcaagatggagtagagagaggccccggccgggcgctttctgctgcctcgcggaggggcgggcacggggagtgaggggtccccaggcccagcgggtgcggggccgggtgaggagacggagctcacccccgttcggaacccagaagcatggcgggtccccacgcgcagcccttcaggggcctcgggagcccgcggcctgggtcacctccggctcccttcaggcggggggcggctgctgccgccaggctcgggcgtgggtgcgggcggtgggcatcccacgggggtaggggaggcgagagcctgaggagactcgggagggggcccgtggacgcggctggcccgggatggagctggcgcggccacagtgggggacgaggcagggcacgcggcgttccccgggctcggcctccctcccagcgcacgggcggtcggaggaactggagcccccaccccggacacggtcccgcgggcgaaggcttctccccgtcgccccggtccggcctccctcccgccgccgccagcagaggccgctgtcccacgcgccgggtcccgttggcgccggggcctcctgggacggcctggccgcggcctgcgggtatgcgctctttccagaaaggcagcacacgcatgtctctgccgtggccccagatcctccccgcgccgccgttttgagcgttcacactcattacccaggtccgtctgggagacccgccgggctcccgccctcccggcccgcagcctcctggccaaaatcctcccgggacaccccacctggactgctgcgaacgggcctccacccgcctccccggacccgcagcgccccccgctccctcagggttctggggtgaaggggtctgaatagcaccaggggaggcggcagggcgggcctgtcctacctgcgcccgagcactgctgagacgacatcccttccagcgccgccacgtagtccagccccagccagccgcgatatctccccacaaacctaaacaatttcgagagggacttgtgttctgcaaccagtcacagaatatcaggtgagctgggcgtgtcttcactgacccacccgcccagggatgctgcactcctctccaccctgctcagaatcactagaatgaccgttctgtggctacagccctaaaagagctactaaaaagaccagaagtagtatgagaacttatgaatacgaatataaataaaggctgtaggcgtgcagctttctaacccatatcttaacagaagtacgccgtgcagggccaag

SEQ ID NO: 287625 - DNA, 1661 bp, Homo sapiens
tttcactctttttcccccctgtatattccttcttttttttttttttcagggtccaagcctcggcatgtgctggcttgtttggctttattttagaaaccaaccaacatgtttcattagcactgacacagcaggggtcccctgctgccacctgacaatccagcgtcacttacactgcacccacgcaggccacaccttcaatggccacggcacgctagcccagagttagccacacagaaacacacttctcaccgcacaaaactcccttttgaaaaaaccaagcaatcgtcaggtcggaggagaatcactagccccccacagcgagaggggacaaagcttggtggccgaggcccaggtccttgtggcccctcccggtggggtgaaggtgcccgggactcctcggggttgcatggctacagccggggcgctgccagggcctcctctgcggctgagagatggaagggatccttcccgacgcccgcaggtgggggcgagccaccgggaaccgggcctgtcaccagcatccccgagcccccgcagaccggaatgcaaatggctccgcgcccacgcggctcccggtctgctgacgagggctgcctgctcccatttcttctcttcctcttcattttttttaagggctgccagttctggaaactttttctggcttctcagacaactgtggcaagatggagtagagagaggccccggccgggcgctttctgctgcctcgcggaggggcgggcacggggagtgaggggtccccaggcccagcgggtgcggggccgggtgaggagacggagctcacccccgttcggaacccagaagcatggcgggtccccacgcgcagcccttcaggggcctcgggagcccgcggcctgggtcacctccggctcccttcaggcggggggcggctgctgccgccaggctcgggcgtgggtgcgggcggtgggcatcccacgggggtaggggaggcgagagcctgaggagactcgggagggggcccgtggacgcggctggcccgggatggagctggcgcggccacagtgggggacgaggcagggcacgcggcgttccccgggctcggcctccctcccagcgcacgggcggtcggaggaactggagcccccaccccggacacggtcccgcgggcgaaggcttctccccgtcgccccggtccggcctccctcccgccgccgccagcagaggccgctgtcccacgcgccgggtcccgttggcgccggggcctcctgggacggcctggccgcggcctgcgggtatgcgctctttccagaaaggcagcacacgcatgtctctgccgtggccccagatcctccccgcgccgccgttttgagcgttcacactcattacccagatatctccccacaaacctaaacaatttcgagagggacttgtgttctgcaaccagtcacagaatatcaggtgagctgggcgtgtcttcactgacccacccgcccagggatgctgcactcctctccaccctgctcagaatcactagaatgaccgttctgtggctacagccctaaaagagctactaaaaagaccagaagtagtatgagaacttatgaatacgaatataaataaaggctgtaggcgtgcagctttctaacccatatcttaacagaagtacgccgtgcagggccaag

SEQ ID NO: 287626 - DNA, 429 bp, Homo sapiens
ccacccgctctcttcccatccaggctgcaacccacgcttcgagggccttgcgcattgcagaggacacggcagcctgctcatcacgctcaactacacctcctgcaagagctttggccaccttgggaggcaggatctagatatctccccacaaacctaaacaatttcgagagggacttgtgttctgcaaccagtcacagaatatcaggtgagctgggcgtgtcttcactgacccacccgcccagggatgctgcactcctctccaccctgctcagaatcactagaatgaccgttctgtggctacagccctaaaagagctactaaaaagaccagaagtagtatgagaacttatgaatacgaatataaataaaggctgtaggcgtgcagctttctaacccatatcttaacagaagtacgccgtgcagggccaag

SEQ ID NO: 287627 - DNA, 797 bp, Homo sapiens
gtaggcgcctcggcggccaccgcgtccccagggggcctcgcggacgggggcgcggggctgcggggaggaggcgggcgggcccctcgggcgacaccgcggggcgggcggcgggaagcccggactcagcggtttcctgggcaaccggcctcctccggcgcggcccgcgcggctccaggtggcgggaggcggcggttggcgggaagggccgcgcgggcccgggggcggcgcctcaggtagcagcgccaggtggcgcccgtgggcggcggggctcccggggaggcgcctgctcccgcccacgccgggcccggccttcgcgagcttccttctggattccagcgcgaagccgccgcggaaactccccgggcgggcatcggagctctggggcggggcggccgggctcagagggcgggcgggagcaggcgggcggcgagggcgggcagcagcagcgggagcaggggcgccccgggcgccggggccgctggggacgaacgcggcgggtcaggccccgaagcccgggccgcggtggccgcctcaggcgcccgctctggggtgggggtgggggcatctttcgggaccgaactcgccgcagcctccctctttgtgctcctttcccctgctgcccttccagatgcgctctttccagaaaggcagcacacgcatgtctctgccgtggccccagatcctccccgcgccgccgttttgagcgttcacactcattacccaggtccgtctgggagacccgccgggctcccgccctcccggcccgcagcctcctggccaaaatcctcccgggacac

SEQ ID NO: 287628 - DNA, 316 bp, Homo sapiens
cggacccgcagcgccccccgctccctcagggttctggggtgaaggggtctgaatagcaccaggggaggcggcagggcgggcctgtcctacctgcgcccgagcactgctgagacgacatcccttccagcgccgccacgtagtccagccccagccagccgcggtaggtggttttctctccgacaggcaccgcccggacggtggcatccttgaaaagcaggtcttggccatgatagttggaggagtcgaacattttgaacccgttcttattgtggtcgtctccaaacaggtcctggaagcaccgcaggcagacgacctg

SEQ ID NO: 287629 - DNA, 7580 bp, Homo sapiens
  misc_feature (3605)..(3605): n is a, c, g, or t
  misc_feature (5763)..(5763): n is a, c, g, or t
tagctttaaataagaaatttattgcaaatatagaaattgattctctccatacaggaatctccgagttgaggaaaacaatttcgtgccattcagttttaaaacaggaaattgagggaagggagaggcagatacagggaagagaaaataaagttaacccccacccccaaaagaagaaaaggagagggttcaaggccctcagaggaaggaaagtttcgtaacacagcaagggttcacaggttcagagcccagggcctgagcccagctctgcaggacccaaaccaggtgcccaaccacagccaacttggggactggcggctcctgaggaagggagggagggagggaagtgtggccgccactgcaggaactccaagcccctgtcccagccctgtgctggagtgtggagtggcagaggggcagaggaaggaggagcaggcccagaccatcctgcccgtcctacaggacccccttcctctccctcctgctcagcaggactgcctgacctttagtgaggcctgaagccgcctctggaggcaagcagtatggaccctggttttgtcttagaagggggacccagggtcagggaaggagtgtgtcaggatggaatctgagcatgagagttagaggaggtcccctctcctggggctcagccacctctggagcagccaccttgtcagacaggagaggtggcaatggggccagccaggcaaggctgccctaaccttcacactggcttccacgggcaaagtaagcccctcagggctgagcttccccaggctccccgacggcttgccccgcccatccacactcatggaaagggggctctgctgggccaggaatgggcaggggcagggtagtaggggacagaggcggtgcttgggggacaggcagccactgcaaccccactccctctagtctcgtcttcacacccacccacccacccacccttctggctcctcttgtcattcacagcttggctccctgtccccccatcccacacaggatgctccctgaccagccttgcccctcccccatcaccctattttaattttctgcaaggcgccagtcactagggagcattgtgtcttatcccttccctgcacttaggccccttataagctaggacctgtcactggtgtccttaattcctgatgccatcccggcctcagcactgtcacaaccgagtttgtcagctctaggtctcctttcctctcctttccgtctctgcacttctgttcaccccgctgttacatttccaggagggagtggggcaggcgaccaacttccagttgagaacatgggtgactctcggccagcctgatactccccactgctgctgccccagctgcctcccggggacgatccaggcctggccttcccaagcaggtctctttactcccaccctcctcgctcccctgacagcccttttcccagacctacccagacacgggctccccagcctggacacaggctgctcccacaggcctcctgcactgcctcaggaggggagcccaggtgagggattctttggtgggcagagagagactcttcctgccgcggggaaaagcaaggccgggacccgtgacgaggtttccccaccaaccaggctttcttgccttcatgccagacctctgtgttttgctactggaaggccataagctccaacagagggttagctgcacctgctgtgccctcccaggaaggagcagacccattgtgctacttcccagaaacagcttcagaggagattctccaacagaggcaggcaagcccaggtgtgaccttgttccggcccaaggcaggaggcctccccgcagaggtccagggcgtggcacccacacatccctcgctccaccgggcctccatctcccctccctccctgtggccccccctgccctcttttcctggtgtctgccctgctggcctgccccagaccacagcccagctccaccatgctcatcatcatcacaaacccagaccttggatggcaacattttgtgaatacttccctcccgcctgggaaaaactcatcctgagcaggacgtgggacacagatgcaggccagcctccgggtgggctctccccaagctgagcagttggggctctggcctggctgggaggccagagacccgagtcttagaccccgctctgcctcacaaagaaccacatgaactgggtcttcaaggccagttcccctcctggatcatcagagtcctgctctttggaagggcccctgtccctgcagtcagagagtctgaggtttcctaaatatcttcacgcagaaaggatggggaaatggcaagcgcaggcccctaactcctgctgctgggaaccctccctggggcccagcccaggcgtgctccttcttcccacgggttcctttctcaaagcccccaccctctccctgaagccccccacgaagccccaagctcctggcctcctacactcagcagtgtgactgatcctccaccccagctggccagccaattcaccaggcccgtctgggagccctgacttcctcatctacaaaacgggaacaagcgggacggacagacagtcccttccaccgggacaagagcccttgaggaggcttccctggggctgccctccctggcatggaggaggggaaggaactggggacaagggaggtggcagtggagagagggagggaggaagggaggtggcacatgggcccaatgctcagaaacacaggaggtgggtgtggggcagggctgtgtcttggtggcacctgttttgggtctgtttttgcagagctgacccctccctgggtttcaagagctgctcgtcagatcacaacagacagaatgtgggaaagcagggcatcagagagggggcgggggagtctggacaaactggcacatacacgacagatgtttgctcagaaaaatacagtaaaatcgtcatgcaaatataacagggagtctgcttcctcacacccctggcttctctgcctgcttgcttttctcagttgtgccaagggggtgtgaggaggggttggggggcaggttttgggggccgggggaggaggtctgctccgcgtatccatgccgccccctcccctcctcgccccaggagaacagtcttttctttgcaaatgtcaccctcaaagtgagccctgggcttcgttaaccccaaagttggtgtgagagaggtactcagctgagcccgagcctcctagccctctgctgtcctccctcaccccctgcccccagcaggaaggtcgttggggtccccaggggatggcactagctttcctggtcagagcccctgcccaccaacagtgccggtcttggacccattccagtgcctaccctcgcccctcagtcacactccccaaatctcaggaaacccatgtgggccacaggccctagactgggggtctctggcaggggcgtggggagagccggggccccccaagctgaggtgggtggcagccaagcgacatgttgctaggcgggcaaagctgctagtagaggcgtccccacaccccgctgggccagctcccacccagaggtgaaggatgatggactccggcccatcagcatcctgactggtcaagaccccagtctcaggaccgcagatttgcntcccaaaagagctggccccaggagctgctgccaggctggccctccctcaccaccctctgccaccgcctacatggacagagaaccccagagcccaacggtcactctgggcaccaactgccaggcacagggttaccatggtgacagaggctggctgggaggggctggggcgccacgaacccagcctgctcctcaaccctctctcgggtgggggcctcactgtttgtgctttgtttgatgttgggtgggggggtcagaaagagggaagtggccattgccacggaaacatgggagcccctctggccagggggccaggcctggatgagcagcccagaggggatgggtgagaaagccctccttccccgggtgggcggctgagataggagccgagatcccacgatggggtcgggcaggtggggacacaggccatggggacaggcaggaagtcccccatgacagctcctccctgcagccctccaggcatcacagtgcaccgctgcccttctgcggtgggcaggggtctcggaggaccagagaagctggggccgggagcctgcacctgagacgtcctgggagctggcctgcccgccacacgccccactcttcccaggccacgtggaagacacttgaagtgggctggtggaatgtcgccctgcctcggctcctttcccgtcaacaggaccctctcccttctcccgggtgccggcataggggtcaaaagccccccaggattctgaatcacagctgcacactctgggggcactgccatgtggctttctaggaagaaaaagcacctgcctgattcccaagtccctcagccccaagggaccacagcttcggaaagggatgtggggtgggcacagggcgggcaggggtccacaagagagctgcagggggttccgggacagcactgggctgggaagttgggggacttgaggctaagctgctgtgtgaccctggggttgtcaactcccttctctgggcctcagtttccccccctctctaaagtggaaggagacattgcccgatgtctaatgctaaatctgcaggtgacttgactcccagcttgggaagggaccctctccctgccctagaggggcttcagtccctctctactccagctttcttgacccccacacctgtttctagccccagaccccccagaccccacaccctctcttggcttccttcctccccccgccagccccccggccctgcacaccccagcagagtccctgggcagcacagtaaagacgactggtttcggtatcagtttgtaaactttaaggaaaatgtgtctctgttttcctgtccgttattgtcggatgttggtttgttcacagtcgggtggtggtcaggtgtgtgtgtgcgtgcgtgcgtgcgggtctgcatgtgcgtcctctcctgggccttggcccccgagtctgctccccgccctggccgcctggacccttcccccaaaaggcccccagccctctggctccgacctcaccagggaggaaggggggggtcacagcttctgctgggcggagacccccttccagtaatcaaggatgtcatgcagatcctcgtccttggcgaactggaccttcttgcgcagggcgtgaccggcggccatgtacacctcctcccggtggtgcttcttgtagggccggaagcgctcccagatcttgtgcgtgctctcggatgagtactcggggctggaggagtaccctgagtagtagtgtctgggggagagctgcgagtaggtggagtcacgcttggagcgggtcagcggcttgaggaaggacacgcgctggctcaggctgtcggcaccctcctcgtagtacagggcgggaaagctgtgccggtgctcgctgcagtggtaggccggcttcacctccaggtggtggatgcccccgcccccgccgctgcccccgccgctgcccgccggcaccagcgggagccggtccagcgggctgttgagggggctgcccttctcgatgtacttggagtcgcccttagccagccctgtggcggccggatggtcgggcacgtccaggctaaagaccttggcgctcttgatggaaccactggacgacacgctgcaggtcttgcgggtcacggccgcgtcggcgctcagctggcgctgtagtgggtggtgggagctctccttgtaggnaggcgaaaggaagctgggccgctccagggccccggggccagtggctgaggaggcggcagcagctgcagggagggactggcactcgaaggccagctcggggtccccactgctgctgccgcctcccagaaaagaggccgagtccagcttgagagcatcgatgcagttgttaatgatctggttgaccttgtccacctccttggcaatggtggagatctctgcagccgagccctggccgttctcgaggtccgggaggtcatcctcgggccgagccagaccgtccccgccggcgcctgtgcgcacctcgatatagttgcctttggtggctaccttgggtgtgtccagcccggcctccaaccccttggcggtgggcagcttctccccgatcatggaggggatggaggccatgcgagatacgggcagcacgggaggctcgcccagcttctgggcggcgtgcacaatggagccggcatccacatcagccccgtagcgcatctccaggatggtcttcttgacgttgacagacttctgcttctcctcctgcatgcgccgcttgcgcaggcagtagtacacggctcccagcacgataaccatgccaaagaggcagcccaggatggtcatgatgtagtgggtggtggtggaggtgctgggcgccaagtctccggggacggggtcccgcgtggtgaaggtcaggcaggtgtggttgaagcggcggctgttgcgcagcgaggtcacgcagaaggtgtactcagtgtgcgcccgcagtttgtccagcgtcacgatctccttcttgttcttgagggtcatgacgtcggagaagtagctgttgttgtactgcacgaggatgtacatcttgctgtaggggtgtgggatgatgaccaccagggtggccgaggtgaacgtgacgtggtgcagcttgatggctggccctgccgacgcatccgtggtggacgaggccggcggctccaccgaaaggatctcgtcggggttgaagcccgagttctcgtctggctccctctgggcgtcggtggagtagggcgtggggtggctcacgggccgggcgggcagcgagccattccgacacttggcctggagtacggtgatggcgttgaggctgtggtagggccggggcaccagcagcgggtagccggcaaactcccgcggcgactcacactgcaggcggtcgtagttcttggtgacgttgttgaagaccaccagccaggccaggaagccgaagaggtcgcactcacagttgaaggggttgccggccagctcacacaccatcaggctggcgaggctggcaaaggtggcaccgtccaggcggctgaggcggttggaggacaggtcgatgctgatgaggctcgggcactcggagaaggcggtgggcgtcaccacctcgatgaggttgtgctggacaaagaggaactgcaggcggctcatgcctcgcagcatgccctccgtcaggttgctgagcttgttgtagcccagctgcaggacctgcaggctcgactggcccaggaaggcaccgtcctcgatgtaggagatctcgttcttggtgaggttgaggtcggtgaggttcccaaagcggttgagcgaggagtagagcacggctttgagcttgttctcgttgagccgcaggtcgtgcacggtgctattgatgtgctgcgggatggtctcgtagggcggctggttctggctgcagatggccagccacacgtagcccttgtcgccctcaatgagccagcagtcggcacgcacggcacccggccggcacacgcacagcagcgccgccgcgcacagccccaggcgcagcatggcgc

SEQ ID NO: 287630 - DNA, 6753 bp, Homo sapiens
  misc_feature (3605)..(3605): n is a, c, g, or t
  misc_feature (5498)..(5498): n is a, c, g, or t
tagctttaaataagaaatttattgcaaatatagaaattgattctctccatacaggaatctccgagttgaggaaaacaatttcgtgccattcagttttaaaacaggaaattgagggaagggagaggcagatacagggaagagaaaataaagttaacccccacccccaaaagaagaaaaggagagggttcaaggccctcagaggaaggaaagtttcgtaacacagcaagggttcacaggttcagagcccagggcctgagcccagctctgcaggacccaaaccaggtgcccaaccacagccaacttggggactggcggctcctgaggaagggagggagggagggaagtgtggccgccactgcaggaactccaagcccctgtcccagccctgtgctggagtgtggagtggcagaggggcagaggaaggaggagcaggcccagaccatcctgcccgtcctacaggacccccttcctctccctcctgctcagcaggactgcctgacctttagtgaggcctgaagccgcctctggaggcaagcagtatggaccctggttttgtcttagaagggggacccagggtcagggaaggagtgtgtcaggatggaatctgagcatgagagttagaggaggtcccctctcctggggctcagccacctctggagcagccaccttgtcagacaggagaggtggcaatggggccagccaggcaaggctgccctaaccttcacactggcttccacgggcaaagtaagcccctcagggctgagcttccccaggctccccgacggcttgccccgcccatccacactcatggaaagggggctctgctgggccaggaatgggcaggggcagggtagtaggggacagaggcggtgcttgggggacaggcagccactgcaaccccactccctctagtctcgtcttcacacccacccacccacccacccttctggctcctcttgtcattcacagcttggctccctgtccccccatcccacacaggatgctccctgaccagccttgcccctcccccatcaccctattttaattttctgcaaggcgccagtcactagggagcattgtgtcttatcccttccctgcacttaggccccttataagctaggacctgtcactggtgtccttaattcctgatgccatcccggcctcagcactgtcacaaccgagtttgtcagctctaggtctcctttcctctcctttccgtctctgcacttctgttcaccccgctgttacatttccaggagggagtggggcaggcgaccaacttccagttgagaacatgggtgactctcggccagcctgatactccccactgctgctgccccagctgcctcccggggacgatccaggcctggccttcccaagcaggtctctttactcccaccctcctcgctcccctgacagcccttttcccagacctacccagacacgggctccccagcctggacacaggctgctcccacaggcctcctgcactgcctcaggaggggagcccaggtgagggattctttggtgggcagagagagactcttcctgccgcggggaaaagcaaggccgggacccgtgacgaggtttccccaccaaccaggctttcttgccttcatgccagacctctgtgttttgctactggaaggccataagctccaacagagggttagctgcacctgctgtgccctcccaggaaggagcagacccattgtgctacttcccagaaacagcttcagaggagattctccaacagaggcaggcaagcccaggtgtgaccttgttccggcccaaggcaggaggcctccccgcagaggtccagggcgtggcacccacacatccctcgctccaccgggcctccatctcccctccctccctgtggccccccctgccctcttttcctggtgtctgccctgctggcctgccccagaccacagcccagctccaccatgctcatcatcatcacaaacccagaccttggatggcaacattttgtgaatacttccctcccgcctgggaaaaactcatcctgagcaggacgtgggacacagatgcaggccagcctccgggtgggctctccccaagctgagcagttggggctctggcctggctgggaggccagagacccgagtcttagaccccgctctgcctcacaaagaaccacatgaactgggtcttcaaggccagttcccctcctggatcatcagagtcctgctctttggaagggcccctgtccctgcagtcagagagtctgaggtttcctaaatatcttcacgcagaaaggatggggaaatggcaagcgcaggcccctaactcctgctgctgggaaccctccctggggcccagcccaggcgtgctccttcttcccacgggttcctttctcaaagcccccaccctctccctgaagccccccacgaagccccaagctcctggcctcctacactcagcagtgtgactgatcctccaccccagctggccagccaattcaccaggcccgtctgggagccctgacttcctcatctacaaaacgggaacaagcgggacggacagacagtcccttccaccgggacaagagcccttgaggaggcttccctggggctgccctccctggcatggaggaggggaaggaactggggacaagggaggtggcagtggagagagggagggaggaagggaggtggcacatgggcccaatgctcagaaacacaggaggtgggtgtggggcagggctgtgtcttggtggcacctgttttgggtctgtttttgcagagctgacccctccctgggtttcaagagctgctcgtcagatcacaacagacagaatgtgggaaagcagggcatcagagagggggcgggggagtctggacaaactggcacatacacgacagatgtttgctcagaaaaatacagtaaaatcgtcatgcaaatataacagggagtctgcttcctcacacccctggcttctctgcctgcttgcttttctcagttgtgccaagggggtgtgaggaggggttggggggcaggttttgggggccgggggaggaggtctgctccgcgtatccatgccgccccctcccctcctcgccccaggagaacagtcttttctttgcaaatgtcaccctcaaagtgagccctgggcttcgttaaccccaaagttggtgtgagagaggtactcagctgagcccgagcctcctagccctctgctgtcctccctcaccccctgcccccagcaggaaggtcgttggggtccccaggggatggcactagctttcctggtcagagcccctgcccaccaacagtgccggtcttggacccattccagtgcctaccctcgcccctcagtcacactccccaaatctcaggaaacccatgtgggccacaggccctagactgggggtctctggcaggggcgtggggagagccggggccccccaagctgaggtgggtggcagccaagcgacatgttgctaggcgggcaaagctgctagtagaggcgtccccacaccccgctgggccagctcccacccagaggtgaaggatgatggactccggcccatcagcatcctgactggtcaagaccccagtctcaggaccgcagatttgcntcccaaaagagctggccccaggagctgctgccaggctggccctccctcaccaccctctgccaccgcctacatggacagagaaccccagagcccaacggtcactctgggcaccaactgccaggcacagggttaccatggtgacagaggctggctgggaggggctggggcgccacgaacccagcctgctcctcaaccctctctcggccctccaggcatcacagtgcaccgctgcccttctgcggtgggcaggggtctcggaggaccagagaagctggggccgggagcctgcacctgagacgtcctgggagctggcctgcccgccacacgccccactcttcccaggccacgtggaagacacttgaagtgggctggtggaatgtcgccctgcctcggctcctttcccgtcaacaggaccctctcccttctcccgggtgccggcataggggtcaaaagccccccaggattctgaatcacagctgcacactctgggggcactgccatgtggctttctaggaagaaaaagcacctgcctgattcccaagtccctcagccccaagggaccacagcttcggaaagggatgtggggtgggcacagggcgggcaggggtccacaagagagctgcagggggttccgggacagcactgggctgggaagttgggggacttgaggctaagctgctgtgtgaccctggggttgtcaactcccttctctgggcctcagtttccccccctctctaaagtggaaggagacattgcccgatgtctaatgctaaatctgcaggtgacttgactcccagcttgggaagggaccctctccctgccctagaggggcttcagtccctctctactccagctttcttgacccccacacctgtttctagccccagaccccccagaccccacaccctctcttggcttccttcctccccccgccagccccccggccctgcacaccccagcagagtccctgggcagcacagtaaagacgactggtttcggtatcagtttgtaaactttaaggaaaatgtgtctctgttttcctgtccgttattgtcggatgttggtttgttcacagtcgggtggtggtcaggtgtgtgtgtgcgtgcgtgcgtgcgggtctgcatgtgcgtcctctcctgggccttggcccccgagtctgctccccgccctggccgcctggacccttcccccaaaaggcccccagccctctggctccgacctcaccagggaggaaggggggggtcacagcttctgctgggcggagacccccttccagtaatcaaggatgtcatgcagatcctcgtccttggcgaactggaccttcttgcgcagggcgtgaccggcggccatgtacacctcctcccggtggtgcttcttgtagggccggaagcgctcccagatcttgtgcgtgctctcggatgagtactcggggctggaggagtaccctgagtagtagtgtctgggggagagctgcgagtaggtggagtcacgcttggagcgggtcagcggcttgaggaaggacacgcgctggctcaggctgtcggcaccctcctcgtagtacagggcgggaaagctgtgccggtgctcgctgcagtggtaggccggcttcacctccaggtggtggatgcccccgcccccgccgctgcccccgccgctgcccgccggcaccagcgggagccggtccagcgggctgttgagggggctgcccttctcgatgtacttggagtcgcccttagccagccctgtggcggccggatggtcgggcacgtccaggctaaagaccttggcgctcttgatggaaccactggacgacacgctgcaggtcttgcgggtcacggccgcgtcggcgctcagctggcgctgtagtgggtggtgggagctctccttgtaggnaggcgaaaggaagctgggccgctccagggccccggggccagtggctgaggaggcggcagcagctgcagggagggactggcactcgaaggccagctcggggtccccactgctgctgccgcctcccagaaaagaggccgagtccagcttgagagcatcgatgcagttgttaatgatctggttgaccttgtccacctccttggcaatggtggagatctctgcagccgagccctggccgttctcgaggtccgggaggtcatcctcgggccgagccagaccgtccccgccggcgcctgtgcgcacctcgatatagttgcctttggtggctaccttgggtgtgtccagcccggcctccaaccccttggcggtgggcagcttctccccgatcatggaggggatggaggccatgcgagatacgggcagcacgggaggctcgcccagcttctgggcggcgtgcacaatggagccggcatccacatcagccccgtagcgcatctccaggatggtcttcttgacgttgacagacttctgcttctcctcctgcatgcgccgcttgcgcaggcagtagtacacggctcccagcacgataaccatgccaaagaggcagcccaggatggtcatgatgtagtgggtggtggtggaggtgctgggcgccaagtctccggggacggggtcccgcgtggtgaaggtcaggcaggtgtggttgaagcggcggctgttgcgcagcgaggtcacgcagaaggtgtactcagtgtgcgcccgcagtttgtccagcgtcacgatctccttcttgttcttgagggtcatgacgtcggagaagtagctgttgttgtactgcacgaggatgtacatcttgctgtaggggtgtgggatgatgaccaccagggtggccgaggtgaacgtgacgtggtgcagcttgatggctggccctgccgacgcatccgtggtggacgaggccggcggctccaccgaaaggatctcgtcggggttgaagcccgagttctcgtctggctccctctgggcgtcggtggagtagggcgtggggtggctcacgggccgggcgggcagcgagccattccgacacttggcctggagtacggtgatggcgttgaggctgtgtcttggcctctgtgggtcaccaattctacaggactttaagctgtcctgaccctctgacagcttccccttggctccatgcggccccactggggagaggtccccaaccaagggagttcccacacagccaccccaggcccac

SEQ ID NO: 287631 - DNA, 435 bp, Homo sapiens
ataaatttaaaaatattttatttctattgaaagaataagtattgtgaaactgccatattatctaaggtgatctctagactcaataaactccctgtcaaaattccagtttttcacagtaatgaaaattacaatcctaaaatgtacacgaaaccacaataaattttgaatagccaaagcaatcttgaggaaaaagaacaaagcagaaggacattatactttataatttcaaactatatatatatacatcgagagagagtcttgctctgccgcccaggctaaagtacagtggcatgatctcagctcattgcaacctctggctcctgggttcaagcaattctcctgcctcagccacctgagcaggacaatcacttcaacctgggaggcagaggttgcagtgagccgagatcgcaccattgcactccagcatgggccaca

SEQ ID NO: 287632 - DNA, 1062 bp, Homo sapiens
ccgctgtagggcccgatgacgatgctggcctggcgggggacttggctgacccggcctccgcacaggtggactagttcacagagcttggccactggggggctgctggcaggcgagacaaacatcgctggctggtcggcaaagagggttccgcggtacggccctgcagacaagtggcactcgcttcggcacagctgtggggcagacagagatagaattacagagcataataaataccgagcctcagcagctttcatgtgccttgcaggagacagtggcagcaggggcaaatgattcttcctggatggtgactttaacaaagacttcttctggggggcaccgatctccacctggccatgtcttcaagcccaaggagaagtcccaggatgggtctgagctaatcacggtgatcgcaatacaaatgactgcgctaagcatggcacagctggcctcaatcctggccaatgcaacgtgagaatcaattgctggtgggattctgggggagtttttctcactgttataaacagatgcaaagcagaaatacttctctttgctggacactgtcatgtctaatgtgacgcctggatcactgaagcccccagaggccacgggacacgctgaaaatggcccagtgggaaggcggaaagccttgggtcctgaaaaacacttctaagtcactgacggaccaaactgaaatcatcctttattttgttcttttcatgtcagaaaaaaagacccctaaattctttaagtgacttttttgttaagtttttgtttctagaagcccaaaatatcctaataataataattttaaataatccacctatttttggaaatagcttgttcatcattgagattatgaataatagatcagttctcacccctgccttccccaccatttaccagagttaacaactgtgaaaaattctctgtgtatttttaaaaatcctgtaaaatgcacacacaacacacacacacatttatgataatgcttgttcttaaccaaaaactgagatctaatctctatctcactatatggataagcagtaaataaacctttttgta

SEQ ID NO: 287633 - DNA, 1409 bp, Homo sapiens
atgtgtggtcatctgtttgactcagaggaccgcgggaaggcccagttattctgaacacgcattttcctaactacgggttggtaaagacttcttcagtgtacacaccctgcgagatgctatgggttatgtgccatccacgttttgttttgcgtattttccctgcttatttttcctacaatatctgaaattaatggttcacacaaattagagatttgaggggatgtatttcggggaagggatgaagggaccttctcagaggagtataacctggggtggggtgacgtcggggtcctctcagtcaggggcagcaggcaaggctgacctcggaggcaggggtagggtgcaggttgggggaagagcagcaaagagtaaattccacagcccacatcactcacaaaatcagagaaacagtgaactattcttctgctaggttttcctactactgtaatatttaacaaaagaggatcctactgtgaaaatatagctccagcatcaatggagtagatccgatacacttatatatgctcatggaatttgcttgttctctccccttgtgttgaattttatagcataataaataccgagcctcagcagctttcatgtgccttgcaggagacagtggcagcaggggcaaatgattcttcctggatggtgactttaacaaagacttcttctggggggcaccgatctccacctggccatgtcttcaagcccaaggagaagtcccaggatgggtctgagctaatcacggtgatcgcaatacaaatgactgcgctaagcatggcacagctggcctcaatcctggccaatgcaacgtgagaatcaattgctggtgggattctgggggagtttttctcactgttataaacagatgcaaagcagaaatacttctctttgctggacactgtcatgtctaatgtgacgcctggatcactgaagcccccagaggccacgggacacgctgaaaatggcccagtgggaaggcggaaagccttgggtcctgaaaaacacttctaagtcactgacggaccaaactgaaatcatcctttattttgttcttttcatgtcagaaaaaaagacccctaaattctttaagtgacttttttgttaagtttttgtttctagaagcccaaaatatcctaataataataattttaaataatccacctatttttggaaatagcttgttcatcattgagattatgaataatagatcagttctcacccctgccttccccaccatttaccagagttaacaactgtgaaaaattctctgtgtatttttaaaaatcctgtaaaatgcacacacaacacacacacacatttatgataatgcttgttcttaaccaaaaactgagatctaatctctatctcactatatggataagcagtaaataaacctttttgta

SEQ ID NO: 287634 - DNA, 2046 bp, Homo sapiens
actgcgaaggaaggaggcaacacgggcaagggctgcctgctgcccgctggagaccgcaccatggagccaggcggggcccgtctgcgtctgcagaggacagaagggctgggaggggagcgggagcgccaaccctgtggagatggaaacactgagacgcacagagccccggacttggtacaatggacccgacacatggaggctgtgaaggcacaattgctggagcaagcgcagggacaactgagggagctgctggatcgggccatgcgggaggctatacaatcctacccatcacaagacaaacctctgcccccacctcccccaggttccttgagcaggacccaggagccatccctggggaaacagaaagttttcatcatccgcaagtccctgcttgatgagctgatggaggtgcagcatttccgcaccatctaccacatgttcatcgctggcctgtgtgtcttcatcatcagcaccctggccatcgacttcattgatgagggcaggctgctgctggagtttgacctactgatcttcagcttcggacagctgccattggcgctggtgacctgggtgcccatgtttctgtccaccctgttggcgccgtaccaggccctacggctgtgggccaggggcacctggacgcaggcgacgggcctgggctgtgcgctgctagccgcccacgccgtggtgctctgcgcgctgccggtccacgtggccgtggagcatcagctcccgccggcctcccgttgtgtcctggtcttcgagcaggttaggttcctgatgaaaagctactccttcctgagagaggctgtgcctgggacccttcgtgccagacgaggtgaggggatccaggcccccagtttctccagctacctctacttcctcttctgcccaacactcatctacagggagacttaccctaggacgccctatgtcaggtggaattatgtggccaagaactttgcccaggccctgggatgtgtgctctatgcctgcttcatcctgggccgcctctgtgttcctgtctttgccaacatgagccgagagcccttcagcacccgtgccctggtgctctctatcctgcatgccacgttgccaggcatcttcatgctgctgctcatcttctttgccttcctccattgctggctcaacgcctttgccgagatgctacgatttggagacaggatgttctaccgggactggtggaactcaacgtccttctccaactactaccgcacttggaacgtggtggtccatgactggctgtacagctacgtgtatcaggatgggctgcggctccttggtgcccgggcccgaggggtagccatgctgggtgtgttcctggtctccgcagtggcccatgagtatatcttctgcttcgtcctggggttcttctatcccgtcatgctgatactcttccttgtcattggaggaatgttgaacttcatgatgcatgaccagcgcaccggcccggcatggaacgtgctgatgtggaccatgctgtttctaggccagggaatccaggtcagcctgtactgccaggagtggtacgcacggcggcactgccccttaccccaggcaactttctgggggctggtgacacctcgatcttggtcctgccatacctagaggtcgggacagacgacgctacctgcccagacaccaccaagttctctgcctgcaaaacctggggaccaggactccctgtctgcattcccaaatttggctctgagtcgaggcaacctgcacacaagaccccaccaaggaatgtgcaaggactgagatctgcagacttgtgggtaactgatcacagacctcagcatgggggtgaccagggtgactcttcaatccctatccccatgggctgggtacaggatatcctcctaccccatgactgtcttagggagacttggggtaccttatggatttgatgaatgtgggggaactcagaggaactggggccaccaaggttggaaaagggtttggttcttgactttgtattccttccaatacagcaataaactttgtctccctttttattcattc

SEQ ID NO: 287635 - DNA, 5867 bp, Homo sapiens
  misc_feature (460)..(460): n is a, c, g, or t
  misc_feature (556)..(556): n is a, c, g, or t
  misc_feature (997)..(997): n is a, c, g, or t
  misc_feature (1390)..(1390): n is a, c, g, or t
  misc_feature (3027)..(3027): n is a, c, g, or t
  misc_feature (3252)..(3252): n is a, c, g, or t
  misc_feature (4555)..(4555): n is a, c, g, or t
  misc_feature (5293)..(5293): n is a, c, g, or t
atcacaaaggcggtgagactgcattcacttacaggttcctatttagggccaagttgctctgcctttccaaatcagcatgggcctcaggccctggctcagccctccaggctcgacttacccggctgatgagctgctcgcccgtctcggaggcagtgatgagtttgcaaagggcttggagggcaggattgggcagacctaaaccaagaaaaaagggtagaagttattcagaagggcctctgcacccaaaagcctgccaccttcccaggggaaagaaccctaaatccttggcatcggtggcatttttcagaagctcagcacagctagacatgtgtgtctgtgtgtgccttggaaaaggacagcgtggtctcccaggaaggtgggtggaagtgggttgagtcctgaccctgccgcagtcctctaggcgtggccacactcccaggacccaggcagcaccaccccnagtcaagcacccagcttcaccctggggttggccgcacagcttcatcggggccacagctgctgatgacaatggcagtagtggccagtgtctgccggnacgacctcccatcatcccgggaaggggcagcgccagtggggcgcagatgcctgccatcacagatggaaacagcaggtaaatggcacttgtttcctccaggtgtggagatgcttgtatctgggaccccctgccatttctcaggacaccctcctgctcctagctgggagatccagcatcctcatgaatgcggggcccaaggccaccaactgttccacctgctgtcagccaggcctgttgccccagccctacacccacagctcacccagcagggactggagtgtgctgctgcactgctggagccggtcgcccgggtcggaggttgggaagaagacagccgctggcaggccactggttggggggtccagccggaagcccacagcggtgaggagggcctgccagccagggatgccgcccactttgttctccacactctgctgggangtgtacatggcattgcgctgcccattctggatgcgctgcagggatttctccacctgagggggaattggggtaaacactgggatgccggagctcaggcatcccagacaggaggaagtgtgtactcacaccagccaggaggaaacaagcctgcctgggaggacagacgatcagccctggctgtccctcaggagcggggggcctccaaggcacactgcccactgggtcaaggagtatccaggaggagttagaagcatgacccatctgcctggcaccagcacctggggctgccaggcagccacccctgcagctgtgttgacaggacctggcagagggactgacccacctttggaaaatgacaccagcaatatcaggatgtgtcaactggatttatgntaagaaaataggatttttggtgttcctctgtttcccaaagtttgagacactttcagacactctgctttgcggttgtggccgatgttacccatgggtgggacttttgctttgctctagatttttgtaacaccctggggagtttcaggggccaatgctgagagaagaccacaggctgacacatcatgaggtgcctaacttactgagaatcatgcctgctgtgatgagcccttggaaaccatcaggactggatggtaggggtcctgagaggattgggggaggaggccttgatatgacagagtggacagaggccgtggaacccaggacagccagcctgctccacaatcctcatccccacagaccttcatgtgtggctcctaaataagaggaaacccactcctgataagtcaggggctttgaaaagtgattttgtttaaatggtgcaaacaagcaagccaatcttggggagacagggctaaacttaagtcctttaagaagctctacatactgacaagattctagttcccttccaccttatatgctgcaaagtaaaaagtatcactgaatgagaaaatcagcataaagaagcccaataatgtctgcctgagtttcccctatgatgacttttggtactttttgggaaacattaagtatgaagttatttcaaaataattttttggtgcctctgcttggtgatgccttaaactctgggtaagagaaacaccaggtgcctgtcaggagatggccttttccaggtttctggttaagctacaaacagctaactggctgctgtcatcaaaataaaagctttctgaaggtggaggcatctgatacccagagtgctgctatcagccggcacggtgggccgctgggtggcaggagcgtcgagaaggccagctcgcttcctatctgggattcagaatcagctatggaaacttgagagacctagagaaaataacttctttcactttgaactgattctttgcttcataagaaaagtattatccagccacaaaaatggtcaaaattcagatctacaaaagcctgtcaggcagaaactgaccccacttaggccacgccaatgagcaagtcatcaaagcagccaagacaggtcctgtgggggccacccatgcacagggcccagcctcgggtcctaaccccgcctatgctttccgccaccataaagaggcccatctgggtaagacctgtcccgcctgctgtggggtattagggcagatggggtctgaggggtctgagggctctgagagcagctggcagctcaaggacatccggagttggaggatggagcaatgcaggcccttgtggtaaagacagtcctgcagccgcgcaggcagggatgctgcaagtggagtgccaggcgggtgcggagccctgtgggactgtggaggggtcagagggaagccaggattttggggtctctgagagtttggagaaggggaagaagattaaagcttgtttcaaaagtttctaatcaggtgggcagggccaagggtggctgtggggtgagacccatgactcagggtggcccactgttactctattgatttttgggcgtttttttccaaattgattattcttgctgaatgagacctgagtccttgactgtccccttaaagccncctgacttgttttcagttccactggcctgtcgggctgttttctactcaactccactcttgcttgtctgccctccctgcctggggcccagccagcagtcagctcaagggccagatgaattgggtggctgtgctctgcccactgggcatcgtgtggatggtgggtgaccagccccctcaggtgctcagccaggcctcaagccttgctgtgtacctcagagcagctcngtaccctgatgtcacagcaaagaaacttagacatgacacaaactgtggcttcccaaggcagcaaagaatggccaggggtcatgagggccgtgccccacttttggacagacctactctaaagtcacgctacctgcgtgcaaatcataaaatcaacacttttgaggagatcacagctatgccttcgtaacacagcccagtccgaccagatagacggtgcctcgtgacccgaaaacaagcccccggccccccaccatgtgtgtgagccttaccttggactgcacgctgagggagcggatggaagggacagcaaggaggccgaagcgctcgtagaggtactcattggaggagcttcccttcaggagggcgaaaggaatgaggtagagctccccctccagaaccaggatgagctgccggtgccggcccacggggccgctggagtgcatcaggccctatggagcaagcacggagaggctgacatgggtggcccagcaggcaggggtttcaggcaccaggacaaccctgagccctagcctggatgacacaagcacgagagacaaatggcttctctggaacatccagctccgaattttaacccagagactatgagagacagaggtcgtcacatccccctcacctcatcttcacgtcaccatcgctatcctccacacctacttactgagccaccaccaagcagttaccctgaagtccagtttccaagcccagagttctcccaggcaacccccaatggatcccgaatgtgtctttgggtggtgaattctgattggattgccgtttcggtcagcgggaccttctgcatatgccctggttgagtacaggtcgagctcttcagaaagcactcatagcaaatgttatgttgatcatgtcctaatctggagtttaagaaagatgcgctccttgcgtatcgccaaggttagaggatctgcaggtgacctccgcggggcaccggggagtttcctttttactggcagacacggcaggcctctcagggattcacagtatcacaggccagaggaatgaaaatctctgatcaccatgggggagggaaagaaaatgcctgggtccatgagctttcagactgattagacttgggatgaaatggactttactgtctacaataaggattccagaggcaaagggcttcagggtatccagataccccagaactgtgtatagggcttcacattttttcctgactgatatttttgatggaataaatttatcaaacagaactgtttaaggtagaggaaccctttctgtgatgctgctgggaaatcctgtcatnatgggtggatacatacagttttggcaaagatcacacacctcctggaaatcaccctcaaccataactgaagcccaccaagactgtagatactgtatttcagccagaaatggaaaagcgaacattcaacccattcaactgtatgctttggccaaacaaccgcccactggtttgcctgaagtacctaagaaggtattggagaaacgtgaccaatggccagcaagagccagaagggcctgcctgaaacccagggtccaacttcagccaaatcagcttgaagggactgttcaagctgcaggagcctctgtgcagtgggcagggttggaggggcggaggggagcctctctctctatcttggctgacctggtaaaaatgatccctccacccctagtggcagaagaccctgacctgcctggaacctgccagggtaaggctaagatgtctgcttgttgaacaccagctagaatagagccagcacgcagatgacactcatgtaacagcagccatccaggtgagaatgccacttaccacgtgagatcttgctggttatcctgggtgctgccaccactggttttagtcatacagacagtttgcaagtaattgcctccatttttcctcctcctaatcagttgtgaaaatgcttgttgtccttgggtgatgtctgtcctcatttgaatatcactacagatgtctcaatcagaaatcaattagacagcctggtggtggggctgccagtctcanaggcctcatcctctacctcatactggaatctaggtctgattgtttctaaggacaaaaattccctggctatacccaagcctcccaatctatttagaaaacaggcagccacgtggtcagtctcattcctgttgcatctgttctaggagaggccgacttatcctgctacctgattttgcaaggggtattttacaaaacacaagggagtcctttcccccagggcagtgattacagtcatgacccaaccaaggccaagccactctcatggccgagccctcggcagagctagacccctgctttcactcttagatgagaagtcttaggtgaaatccctgagctccagtgcttggaaagcagttcaacagcctaacagacataaacaagttttgaataagtttctaggattttaaacaggtgactccacacttcatgaatcacaagctgaggtgaatgagatgtacttttctttctgatcaaagtcatttgctcttgctacctgtcctagaaccttggtttttaaatttaaatacaggaaacagggaatttaaataaagggaaataaaagtaaggataacag

SEQ ID NO: 287636 - DNA, 2328 bp, Homo sapiens
  misc_feature (1016)..(1016): n is a, c, g, or t
  misc_feature (1754)..(1754): n is a, c, g, or t
ggacagcgctaacatccattcctcacaggcctatgaggccaaggtagctgcacagtgggtaaagcatctagccccatgcctggcactggtgtgcactccagacatattggtcaaatgcgaatttacaactgtcttcagtgcttggaataaagtgatactgcccctattatttatactattcttttctcctggcccataatcatttttccagtattactcattccctttctctctggcgtttacaaacattcatgtggctaaaagagacaaatggcttctctggaacatccagctccgaattttaacccagagactatgagagacagaggtcgtcacatccccctcacctcatcttcacgtcaccatcgctatcctccacacctacttactgagccaccaccaagcagttaccctgaagtccagtttccaagcccagagttctcccaggcaacccccaatggatcccgaatgtgtctttgggtggtgaattctgattggattgccgtttcggtcagcgggaccttctgcatatgccctggttgagtacaggtcgagctcttcagaaagcactcatagcaaatgttatgttgatcatgtcctaatctggagtttaagaaagatgcgctccttgcgtatcgccaaggttagaggatctgcaggtgacctccgcggggcaccggggagtttcctttttactggcagacacggcaggcctctcagggattcacagtatcacaggccagaggaatgaaaatctctgatcaccatgggggagggaaagaaaatgcctgggtccatgagctttcagactgattagacttgggatgaaatggactttactgtctacaataaggattccagaggcaaagggcttcagggtatccagataccccagaactgtgtatagggcttcacattttttcctgactgatatttttgatggaataaatttatcaaacagaactgtttaaggtagaggaaccctttctgtgatgctgctgggaaatcctgtcatnatgggtggatacatacagttttggcaaagatcacacacctcctggaaatcaccctcaaccataactgaagcccaccaagactgtagatactgtatttcagccagaaatggaaaagcgaacattcaacccattcaactgtatgctttggccaaacaaccgcccactggtttgcctgaagtacctaagaaggtattggagaaacgtgaccaatggccagcaagagccagaagggcctgcctgaaacccagggtccaacttcagccaaatcagcttgaagggactgttcaagctgcaggagcctctgtgcagtgggcagggttggaggggcggaggggagcctctctctctatcttggctgacctggtaaaaatgatccctccacccctagtggcagaagaccctgacctgcctggaacctgccagggtaaggctaagatgtctgcttgttgaacaccagctagaatagagccagcacgcagatgacactcatgtaacagcagccatccaggtgagaatgccacttaccacgtgagatcttgctggttatcctgggtgctgccaccactggttttagtcatacagacagtttgcaagtaattgcctccatttttcctcctcctaatcagttgtgaaaatgcttgttgtccttgggtgatgtctgtcctcatttgaatatcactacagatgtctcaatcagaaatcaattagacagcctggtggtggggctgccagtctcanaggcctcatcctctacctcatactggaatctaggtctgattgtttctaaggacaaaaattccctggctatacccaagcctcccaatctatttagaaaacaggcagccacgtggtcagtctcattcctgttgcatctgttctaggagaggccgacttatcctgctacctgattttgcaaggggtattttacaaaacacaagggagtcctttcccccagggcagtgattacagtcatgacccaaccaaggccaagccactctcatggccgagccctcggcagagctagacccctgctttcactcttagatgagaagtcttaggtgaaatccctgagctccagtgcttggaaagcagttcaacagcctaacagacataaacaagttttgaataagtttctaggattttaaacaggtgactccacacttcatgaatcacaagctgaggtgaatgagatgtacttttctttctgatcaaagtcatttgctcttgctacctgtcctagaaccttggtttttaaatttaaatacaggaaacagggaatttaaataaagggaaataaaagtaaggataacag

SEQ ID NO: 287637 - DNA, 494 bp, Homo sapiens
gcggacacagcctcattcctgttcattgcagaacaaggctaagggcgcgggcatcttaatgagagcagcaggcaacaatcctggaagctgggtccacacagactgcggtgaacaaagaggtggcgtggaagctgctgctgcagcccagagcctgccaagaaggtcccaggtccacagggcctgcgcaacactgggtgccaggggtggggctggcctgccccccaaccccatctgctgaggagtggctgacaagcggacacccaccagggtgccactcgcttgtgcctggggaagcaaatgtgctcgcttgacccgtctgatgtgctgccgtgggcacttgactgagagtggcagagcactaggctaacccaaagtgacacatgcctggcgggatgttcagtctctgtaaacccatatggtttttttttttctttcctttaaaaaaaatttctagctccatctagcgaaagcagaaataaaaagtattaggccaa

SEQ ID NO: 287638 - DNA, 4022 bp, Homo sapiens
  misc_feature (460)..(460): n is a, c, g, or t
  misc_feature (556)..(556): n is a, c, g, or t
  misc_feature (997)..(997): n is a, c, g, or t
  misc_feature (1390)..(1390): n is a, c, g, or t
  misc_feature (3027)..(3027): n is a, c, g, or t
  misc_feature (3252)..(3252): n is a, c, g, or t
atcacaaaggcggtgagactgcattcacttacaggttcctatttagggccaagttgctctgcctttccaaatcagcatgggcctcaggccctggctcagccctccaggctcgacttacccggctgatgagctgctcgcccgtctcggaggcagtgatgagtttgcaaagggcttggagggcaggattgggcagacctaaaccaagaaaaaagggtagaagttattcagaagggcctctgcacccaaaagcctgccaccttcccaggggaaagaaccctaaatccttggcatcggtggcatttttcagaagctcagcacagctagacatgtgtgtctgtgtgtgccttggaaaaggacagcgtggtctcccaggaaggtgggtggaagtgggttgagtcctgaccctgccgcagtcctctaggcgtggccacactcccaggacccaggcagcaccaccccnagtcaagcacccagcttcaccctggggttggccgcacagcttcatcggggccacagctgctgatgacaatggcagtagtggccagtgtctgccggnacgacctcccatcatcccgggaaggggcagcgccagtggggcgcagatgcctgccatcacagatggaaacagcaggtaaatggcacttgtttcctccaggtgtggagatgcttgtatctgggaccccctgccatttctcaggacaccctcctgctcctagctgggagatccagcatcctcatgaatgcggggcccaaggccaccaactgttccacctgctgtcagccaggcctgttgccccagccctacacccacagctcacccagcagggactggagtgtgctgctgcactgctggagccggtcgcccgggtcggaggttgggaagaagacagccgctggcaggccactggttggggggtccagccggaagcccacagcggtgaggagggcctgccagccagggatgccgcccactttgttctccacactctgctgggangtgtacatggcattgcgctgcccattctggatgcgctgcagggatttctccacctgagggggaattggggtaaacactgggatgccggagctcaggcatcccagacaggaggaagtgtgtactcacaccagccaggaggaaacaagcctgcctgggaggacagacgatcagccctggctgtccctcaggagcggggggcctccaaggcacactgcccactgggtcaaggagtatccaggaggagttagaagcatgacccatctgcctggcaccagcacctggggctgccaggcagccacccctgcagctgtgttgacaggacctggcagagggactgacccacctttggaaaatgacaccagcaatatcaggatgtgtcaactggatttatgntaagaaaataggatttttggtgttcctctgtttcccaaagtttgagacactttcagacactctgctttgcggttgtggccgatgttacccatgggtgggacttttgctttgctctagatttttgtaacaccctggggagtttcaggggccaatgctgagagaagaccacaggctgacacatcatgaggtgcctaacttactgagaatcatgcctgctgtgatgagcccttggaaaccatcaggactggatggtaggggtcctgagaggattgggggaggaggccttgatatgacagagtggacagaggccgtggaacccaggacagccagcctgctccacaatcctcatccccacagaccttcatgtgtggctcctaaataagaggaaacccactcctgataagtcaggggctttgaaaagtgattttgtttaaatggtgcaaacaagcaagccaatcttggggagacagggctaaacttaagtcctttaagaagctctacatactgacaagattctagttcccttccaccttatatgctgcaaagtaaaaagtatcactgaatgagaaaatcagcataaagaagcccaataatgtctgcctgagtttcccctatgatgacttttggtactttttgggaaacattaagtatgaagttatttcaaaataattttttggtgcctctgcttggtgatgccttaaactctgggtaagagaaacaccaggtgcctgtcaggagatggccttttccaggtttctggttaagctacaaacagctaactggctgctgtcatcaaaataaaagctttctgaaggtggaggcatctgatacccagagtgctgctatcagccggcacggtgggccgctgggtggcaggagcgtcgagaaggccagctcgcttcctatctgggattcagaatcagctatggaaacttgagagacctagagaaaataacttctttcactttgaactgattctttgcttcataagaaaagtattatccagccacaaaaatggtcaaaattcagatctacaaaagcctgtcaggcagaaactgaccccacttaggccacgccaatgagcaagtcatcaaagcagccaagacaggtcctgtgggggccacccatgcacagggcccagcctcgggtcctaaccccgcctatgctttccgccaccataaagaggcccatctgggtaagacctgtcccgcctgctgtggggtattagggcagatggggtctgaggggtctgagggctctgagagcagctggcagctcaaggacatccggagttggaggatggagcaatgcaggcccttgtggtaaagacagtcctgcagccgcgcaggcagggatgctgcaagtggagtgccaggcgggtgcggagccctgtgggactgtggaggggtcagagggaagccaggattttggggtctctgagagtttggagaaggggaagaagattaaagcttgtttcaaaagtttctaatcaggtgggcagggccaagggtggctgtggggtgagacccatgactcagggtggcccactgttactctattgatttttgggcgtttttttccaaattgattattcttgctgaatgagacctgagtccttgactgtccccttaaagccncctgacttgttttcagttccactggcctgtcgggctgttttctactcaactccactcttgcttgtctgccctccctgcctggggcccagccagcagtcagctcaagggccagatgaattgggtggctgtgctctgcccactgggcatcgtgtggatggtgggtgaccagccccctcaggtgctcagccaggcctcaagccttgctgtgtacctcagagcagctcngtaccctgatgtcacagcaaagaaacttagacatgacacaaactgtggcttcccaaggcagcaaagaatggccaggggtcatgagggccgtgccccacttttggacagacctactctaaagtcacgctacctgcgtgcaaatcataaaatcaacacttttgaggagatcacagctatgccttcgtaacacagcccagtccgaccagatagacggtgcctcgtgacccgaaaacaagcccccggccccccaccatgtgtgtgagccttaccttggactgcacgctgagggagcggatggaagggacagcaaggaggccgaagcgctcgtagaggtactcattggaggagcttcccttcaggagggcgaaaggaatgaggtagagctccccctccagaaccaggatgagctgccggtgccggcccacggggccgctggagtgcatcaggccctatggagcaagcacggagaggctgacatgggtggcccagcaggcaggggtttcaggcaccaggacaaccctgagccctagcctggatgacacaagcacgagtcgcttgtgcctggggaagcaaatgtgctcgcttgacccgtctgatgtgctgccgtgggcacttgactgagagtggcagagcactaggctaacccaaagtgacacatgcctggcgggatgttcagtctctgtaaacccatatggtttttttttttctttcctttaaaaaaaatttctagctccatctagcgaaagcagaaataaaaagtattaggccaa

SEQ ID NO: 287639 - DNA, 395 bp, Homo sapiens
taaacactgggatgccggagctcaggcatcccagacaggaggaagtgtgtactcacaccagccaggaggaaacaagcctgcctgggaggacagacgatcagccctggctgtccctcaggagcggggggcctccaaggcacactgcccactgggtcaaggagtatccaggaggagttagaaggtaggggctggggaacttgacccatggcccccacacccaccccagaagataataccaaggaaaaagaggaaacccttaagtgggcctgaggggcctcaaggccatgtaggggcagctgagaggcctggcctgggaggaggtgactaatgggtagagaaggcagttccatttccccaaaaaagcagtgtgtagtggcagcaaggacggagggact

SEQ ID NO: 287640 - DNA, 567 bp, Homo sapiens
tggctggccaagaaaaattggcatctggcatacctaggaatcattcaaaatagtttaataggaaggacattttgaggccagccagcattatgacatttgtgggtcctacggcatttcaccttggaaacattttcctgggcatctaaaagtattgtggacctgagacactgtgcttacagggcctactgggttgattctaaagaagaaagaaaatctatatgcatgaaaagatgtcttaaaaagttttgaactactcaaagttaagatttggggaaatagaaatagtatataacttaagaaaattgccactggctgtgaacccccatggcattttctttgcacttttttgcttctcgttagattgtatgtgtttttaccatttcacacaaacttttaaagattattccacgccgttagctctgtgcttctattagtgtctctatctctctttctctctctcttccatctgagtacaatggctagaaaataatacacacttgaatgaataaatgtcatttaaatattttaataaacagaaggaatagtacaatatatttcccttgacca

SEQ ID NO: 287641 - DNA, 535 bp, Homo sapiens
tggctggccaagaaaaattggcatctggcatacctaggaatcattcaaaatagtttaataggaaggacattttgaggccagccagcattatgacatttgtgggtcctacggcatttcaccttggaaacattttcctgggcatctaaaagtattgtggacctgagacactgtgcttacagggcctactggttttcactgtatgagaccgagaatggattatggcagttcctcttacctccgctgcatacttgactccatccacggtgtgctcagagccatgatcatccgaagagccccagtgaagatgaaactggcgaagtcggtagggtccagggagaggaccccctctcagcactgtgattcagataagcttggtcaacagtgaattcatgcttcttttacagagctctactttaaccaagtgctcttagagccaaggcttaatggacaaaatgtggtcagtttgctgggtggatggtgccactcccaggacactggactcctcacaaaatgaagtctggggatatgtcaagat

SEQ ID NO: 287642 - DNA, 4608 bp, Homo sapiens
aagacaacgtcactagcagtttctggagctacttgccaaggctgagtgtgagctgagcctgccccaccaccaagatgatcctgagcttgctgttcagccttgggggccccctgggctgggggctgctgggggcatgggcccaggcttccagtactagcctctctgatctgcagagctccaggacacctggggtctggaaggcagaggctgaggacaccagcaaggaccccgttggacgtaactggtgcccctacccaatgtccaagctggtcaccttactagctctttgcaaaacagagaaattcctcatccactcgcagcagccgtgtccgcagggagctccagactgccagaaagtcaaagtcatgtaccgcatggcccacaagccagtgtaccaggtcaagcagaaggtgctgacctctttggcctggaggtgctgccctggctacacgggccccaactgcgagcaccacgattccatggcaatccctgagcctgcagatcctggtgacagccaccaggaacctcaggatggaccagtcagcttcaaacctggccaccttgctgcagtgatcaatgaggttgaggtgcaacaggaacagcaggaacatctgctgggagatctccagaatgatgtgcaccgggtggcagacagcctgccaggcctgtggaaagccctgcctggtaacctcacagctgcagtgatggaagcaaatcaaacagggcacgagttccctgatagatccttggagcaggtgctgctaccccacgtggacaccttcctacaagtgcatttcagccccatctggaggagctttaaccaaagcctgcacagccttacccaggccataagaaacctgtctcttgacgtggaggccaaccgccaggccatctccagagtccaggacagtgccgtggccagggctgacttccaggagcttggtgccaaatttgaggccaaggtccaggagaacactcagagagtgggtcagctgcgacaggacgtggaggaccgcctgcacgcccagcactttaccctgcaccgctcgatctcagagctccaagccgatgtggacaccaaattgaagaggctgcacaaggctcaggaggccccagggaccaatggcagtctggtgttggcaacgcctggggctggggcaaggcctgagccggacagcctgcaggccaggctgggccagctgcagaggaacctctcagagctgcacatgaccacggcccgcagggaggaggagttgcagtacaccctggaggacatgagggccaccctgacccggcacgtggatgagatcaaggaactgtactccgaatcggacgagactttcgatcagattagcaaggtggagcggcaggtggaggagctgcaggtgaaccacacggcgctccgtgagctgcgcgtgatcctgatggagaagtctctgatcatggaggagaacaaggaggaggtggagcggcagctcctggagctcaacctcacgctgcagcacctgcagggtggccatgccgacctcatcaagtacgtgaaggactgcaattgccagaagctctatttagacctggacgtcatccgggagggccagagggacgccacgcgtgccctggaggagacccaggtgagcctggacgagcggcggcagctggacggctcctccctgcaggccctgcagaacgccgtggacgccgtgtcgctggccgtggacgcgcacaaagcggagggcgagcgggcgcgggcggccacgtcgcggctccggagccaagtgcaggcgctggatgacgaggtgggcgcgctgaaggcggccgcggccgaggcccgccacgaggtgcgccagctgcacagcgccttcgccgccctgctggaggacgcgctgcggcacgaggcggtgctggccgcgctcttcggggaggaggtgctggaggagatgtctgagcagacgccgggaccgctgcccctgagctacgagcagatccgcgtggccctgcaggacgccgctagcgggctgcaggagcaggcgctcggctgggacgagctggccgcccgagtgacggccctggagcaggcctcggagcccccgcggccggcagagcacctggagcccagccacgacgcgggccgcgaggaggccgccaccaccgccctggccgggctggcgcgggagctccagagcctgagcaacgacgtcaagaatgtcgggcggtgctgcgaggccgaggccggggccggggccgcctccctcaacgcctcccttgacggcctccacaacgcactcttcgccactcagcgcagcttggagcagcaccagcggctcttccacagcctctttgggaacttccaagggctcatggaagccaacgtcagcctggacctggggaagctgcagaccatgctgagcaggaaagggaagaagcagcagaaagacctggaagctccccggaagagggacaagaaggaagcggagcctttggtggacatacgggtcacagggcctgtgccaggtgccttgggcgcggcgctctgggaggcaggatcccctgtggccttctatgccagcttttcagaagggacggctgccctgcagacagtgaagttcaacaccacatacatcaacattggcagcagctacttccctgaacatggctacttccgagcccctgagcgtggtgtctacctgtttgcagtgagcgttgaatttggcccagggccaggcaccgggcagctggtgtttggaggtcaccatcggactccagtctgtaccactgggcaggggagtggaagcacagcaacggtctttgccatggctgagctgcagaagggtgagcgagtatggtttgagttaacccagggatcaataacaaagagaagcctgtcgggcactgcatttgggggcttcctgatgtttaagacctgaaccccagccccaatctgatcagacatcatggactcgcccagctctcctcggcctggggctctggccaaggatgggctggaggtcattcagttggtctgtctcttccctggaaaccttctgcaaagatggtgtggtgtacgtggcttccctgtaaccacatggggcttggccatttctccatgatgagaaggactggaatgcttctccgggcaggacatggtcctaggaagcctgaaccttggcttggcatgccttctcagacagcacggcctgggctccaactcttcaccacaccctgtattctacaacttctttggtgttttgctcctcctgtggttggaaacttctgtacaacactttaaacttttctcttgcttcctcttctcttctcccttatcgtatgatagaaagacattcttccccaggaggaatgtttaaaatggaggcaacattttggccaacattggaaagcactagagggcaatgggattaaaccaacctgcttggtctctattagtcagtaatgaagacgacagcctggccaaccaagggaaaggaaattagtatctttagtttcagtcattccttgtaggatatggtttagctgtgcccccacctaaaatatcatcttgaattgtaatccctataatccccacatcaagggagagatcaggtggaggtaattggatcttgggggcggttcccccatgctgttcttgtgatagttctcacgagatctgatgattttataagtttgatagttcctcctgtgttcattctccttcctgccaccttgtgaagatgccttggttcctcttcactgtctgccatgattgtaagtttcctgaggcctccccagccatgtggaacagtgagtcaattaaacctctttcctttataaattatccagtcttgggcaattcttgatagcagtgtgaaaatggactaatacacttgtgtttatctgtaatttaaatttcatgtctttttctccttgccttacatagggtaaagaccaagaaatgccaaacgtgaactaaaatatgtagggccttcaacttttttacttcctccagtatcttaggaccatcgtaattcttgttagcatctctaaccaggaggcagctgagggaggagggaaagaagactgtaaaaatccccctcactaatgatcaactttggaataaagtgatgcccttcaaatctctgcctcatttacttctggagggcaaaaataattggtagagtaggtaaaaaaaacatgggacaacgtgaaactatgtgggtaaatgtgactgattattccaggccctgttatgtagaatgatttccgtttattctatataaaacacttggaagtttccacactaggcaaagatactaatactggactagacagtacagctcatagctgcaattattcctgtaatataccagcatatggttttcaaaaaagttcagatcctatagcaaactggcctgagaaaacagtcatctagctatcagaaacaaggttttttttggtattaagtactcaaaatttgttgaatatagtcttctctataagaaaatcagattgctgaggcaggagaatcggttgaacccgggaggcggaggttgcagtgagctgagatggtgacactgcaccccagcctgggagacagagcgagactctgtctcaaaa

SEQ ID NO: 287643 - DNA, 834 bp, Homo sapiens
  misc_feature (795)..(795): n is a, c, g, or t
cccagatcccatcctccggaaagggttagtcaggcaagtgtgctgagaggcccctgggaacctcgtctcgattaacccatcagaaagcagcccatcctttgcacccagctctcagatggaaaagtgaagcccagaaggaagggacctgacacggaggcttccttggtagcatttcagtctcaagggaagaactgtgggcctcccctggagcactggtgaagtaaggggttggtttggatattgtctcctgactgggatatgggcaggactgacagggagctggagtcctaacgaagcctgggctaggtgcaggaagaaccaacccagtggtctcctgacatctcccacgcccccaccgcagctgggtcacctccagaatacggaggagagagctggaggtggaggaactaaggaccttctttgccaggtggggacttaaagcatacagtgaagttgttctctgaagttcctcatctgccttaagtctggacccaccaaagaagaaaacaatgaccactggtcccttcccggagttttctctgactgaactgctgtcacaggaagaaagactgaagcctgctcacatacctggacagattttgcaaaccgttgtctgctctgtgagcccaacagactttgtcccaggccactgtatgttcttcaagcccactgaattcccctgaaaatcatttactagccccctgaaattacccacacttccccattgctcatctgtaccccatttcgtggtggggcagtcactctgatttccccttgcatgctaatgaatgtgtntccatttctatctgtcagacgattcacggacttaaggag

SEQ ID NO: 287644 - DNA, 579 bp, Homo sapiens
  misc_feature (540)..(540): n is a, c, g, or t
gcagtgaggtcggtctcacccaaacgcatgtggcagggacttggatcctcgaatctgcctaggtgcctgtaaaccctagggctctggcatcatcggagcccccagccccaaacagctgcaggggcactgctgactggctctctgcctgtagccagagacccagtggatgcagccggagagggcctgcatacagtgaagttgttctctgaagttcctcatctgccttaagtctggacccaccaaagaagaaaacaatgaccactggtcccttcccggagttttctctgactgaactgctgtcacaggaagaaagactgaagcctgctcacatacctggacagattttgcaaaccgttgtctgctctgtgagcccaacagactttgtcccaggccactgtatgttcttcaagcccactgaattcccctgaaaatcatttactagccccctgaaattacccacacttccccattgctcatctgtaccccatttcgtggtggggcagtcactctgatttccccttgcatgctaatgaatgtgtntccatttctatctgtcagacgattcacggacttaaggag

SEQ ID NO: 287645 - DNA, 827 bp, Homo sapiens
  misc_feature (788)..(788): n is a, c, g, or t
cccagatcccatcctccggaaagggttagtcaggcaagtgtgctgagaggcccctgggaacctcgtctcgattaacccatcagaaagcagcccatcctttgcacccagctctcagatggaaaagtgaagcccagaaggaagggacctgacacggaggcttccttggtagcatttcagtctcaagggaagaactgtgggcctcccctggagcactggtgaactgggtcacctccagaatacggaggagagagctggaggtggaggaactaaggaccttctttgccaggtggggacttaaagtttcagttactcattgttggggctcagaaaccaataccccgaaatatagtggtgtgacattctgaactgaagaagccttaaggtctctccgaccagactcccacaggccccccaaccctttgtctcttccaaagcatacagtgaagttgttctctgaagttcctcatctgccttaagtctggacccaccaaagaagaaaacaatgaccactggtcccttcccggagttttctctgactgaactgctgtcacaggaagaaagactgaagcctgctcacatacctggacagattttgcaaaccgttgtctgctctgtgagcccaacagactttgtcccaggccactgtatgttcttcaagcccactgaattcccctgaaaatcatttactagccccctgaaattacccacacttccccattgctcatctgtaccccatttcgtggtggggcagtcactctgatttccccttgcatgctaatgaatgtgtntccatttctatctgtcagacgattcacggacttaaggag

SEQ ID NO: 287646 - DNA, 657 bp, Homo sapiens
  misc_feature (577)..(577): n is a, c, g, or t
  misc_feature (606)..(606): n is a, c, g, or t
  misc_feature (609)..(609): n is a, c, g, or t
aagacaacgtcactagcagtttctggagctacttgccaaggctgagtgtgagctgagcctgccccaccaccaagatgatcctgagcttgctgttcagccttgggggccccctgggctgggggctgctgggggcatgggcccaggcttccagtactagcctctctgatctgcagagctccaggacacctggggtctggaaggcagaggctgaggacaccagcaaggaccccgttggacgtaactggtgcccctacccaatgtccaagctggtcaccttactagctctttgcaaaacagagaaattcctcatccactcgcagcagccgtgtccgcagggagctccagactgccagaaagtcaaagtcatgtaccgcatggcccacaagccagtgtaccaggtcaagcagaaggtgctgacctctttggcctggaggtgctgccctggctacacgggccccaactgcgagcaccacgattccatggcaatccctgagcctgcagatcctggtgacagccaccaggaacctcaggatggaccagtcagcttcaaacctgggccacctttgctgcagtgatnaaattgaagggttgaagggtgcaaacaanggnaacaagcaagggaaacaatcctggctggggaagaattctccaaagaaa

SEQ ID NO: 287647 - DNA, 4682 bp, Homo sapiens
cccagatcccatcctccggaaagggttagtcaggcaagtgtgctgagaggcccctgggaacctcgtctcgattaacccatcagaaagcagcccatcctttgcacccagctctcagatggaaaagtgaagcccagaaggaagggacctgacacggaggcttccttggtagcatttcagtctcaagggaagaactgtgggcctcccctggagcactggtgaagtaaggggttggtttggatattgtctcctgactgggatatgggcaggactgacagggagctggagtcctaacgaagcctgggctaggtgcaggaagaaccaacccagtggtctcctgacatctcccacgcccccaccgcagctgggtcacctccagaatacggaggagagagctggaggtggaggaactaaggaccttctttgccaggtggggacttaaaggtaccgcatggcccacaagccagtgtaccaggtcaagcagaaggtgctgacctctttggcctggaggtgctgccctggctacacgggccccaactgcgagcaccacgattccatggcaatccctgagcctgcagatcctggtgacagccaccaggaacctcaggatggaccagtcagcttcaaacctggccaccttgctgcagtgatcaatgaggttgaggtgcaacaggaacagcaggaacatctgctgggagatctccagaatgatgtgcaccgggtggcagacagcctgccaggcctgtggaaagccctgcctggtaacctcacagctgcagtgatggaagcaaatcaaacagggcacgagttccctgatagatccttggagcaggtgctgctaccccacgtggacaccttcctacaagtgcatttcagccccatctggaggagctttaaccaaagcctgcacagccttacccaggccataagaaacctgtctcttgacgtggaggccaaccgccaggccatctccagagtccaggacagtgccgtggccagggctgacttccaggagcttggtgccaaatttgaggccaaggtccaggagaacactcagagagtgggtcagctgcgacaggacgtggaggaccgcctgcacgcccagcactttaccctgcaccgctcgatctcagagctccaagccgatgtggacaccaaattgaagaggctgcacaaggctcaggaggccccagggaccaatggcagtctggtgttggcaacgcctggggctggggcaaggcctgagccggacagcctgcaggccaggctgggccagctgcagaggaacctctcagagctgcacatgaccacggcccgcagggaggaggagttgcagtacaccctggaggacatgagggccaccctgacccggcacgtggatgagatcaaggaactgtactccgaatcggacgagactttcgatcagattagcaaggtggagcggcaggtggaggagctgcaggtgaaccacacggcgctccgtgagctgcgcgtgatcctgatggagaagtctctgatcatggaggagaacaaggaggaggtggagcggcagctcctggagctcaacctcacgctgcagcacctgcagggtggccatgccgacctcatcaagtacgtgaaggactgcaattgccagaagctctatttagacctggacgtcatccgggagggccagagggacgccacgcgtgccctggaggagacccaggtgagcctggacgagcggcggcagctggacggctcctccctgcaggccctgcagaacgccgtggacgccgtgtcgctggccgtggacgcgcacaaagcggagggcgagcgggcgcgggcggccacgtcgcggctccggagccaagtgcaggcgctggatgacgaggtgggcgcgctgaaggcggccgcggccgaggcccgccacgaggtgcgccagctgcacagcgccttcgccgccctgctggaggacgcgctgcggcacgaggcggtgctggccgcgctcttcggggaggaggtgctggaggagatgtctgagcagacgccgggaccgctgcccctgagctacgagcagatccgcgtggccctgcaggacgccgctagcgggctgcaggagcaggcgctcggctgggacgagctggccgcccgagtgacggccctggagcaggcctcggagcccccgcggccggcagagcacctggagcccagccacgacgcgggccgcgaggaggccgccaccaccgccctggccgggctggcgcgggagctccagagcctgagcaacgacgtcaagaatgtcgggcggtgctgcgaggccgaggccggggccggggccgcctccctcaacgcctcccttgacggcctccacaacgcactcttcgccactcagcgcagcttggagcagcaccagcggctcttccacagcctctttgggaacttccaagggctcatggaagccaacgtcagcctggacctggggaagctgcagaccatgctgagcaggaaagggaagaagcagcagaaagacctggaagctccccggaagagggacaagaaggaagcggagcctttggtggacatacgggtcacagggcctgtgccaggtgccttgggcgcggcgctctgggaggcaggatcccctgtggccttctatgccagcttttcagaagggacggctgccctgcagacagtgaagttcaacaccacatacatcaacattggcagcagctacttccctgaacatggctacttccgagcccctgagcgtggtgtctacctgtttgcagtgagcgttgaatttggcccagggccaggcaccgggcagctggtgtttggaggtcaccatcggactccagtctgtaccactgggcaggggagtggaagcacagcaacggtctttgccatggctgagctgcagaagggtgagcgagtatggtttgagttaacccagggatcaataacaaagagaagcctgtcgggcactgcatttgggggcttcctgatgtttaagacctgaaccccagccccaatctgatcagacatcatggactcgcccagctctcctcggcctggggctctggccaaggatgggctggaggtcattcagttggtctgtctcttccctggaaaccttctgcaaagatggtgtggtgtacgtggcttccctgtaaccacatggggcttggccatttctccatgatgagaaggactggaatgcttctccgggcaggacatggtcctaggaagcctgaaccttggcttggcatgccttctcagacagcacggcctgggctccaactcttcaccacaccctgtattctacaacttctttggtgttttgctcctcctgtggttggaaacttctgtacaacactttaaacttttctcttgcttcctcttctcttctcccttatcgtatgatagaaagacattcttccccaggaggaatgtttaaaatggaggcaacattttggccaacattggaaagcactagagggcaatgggattaaaccaacctgcttggtctctattagtcagtaatgaagacgacagcctggccaaccaagggaaaggaaattagtatctttagtttcagtcattccttgtaggatatggtttagctgtgcccccacctaaaatatcatcttgaattgtaatccctataatccccacatcaagggagagatcaggtggaggtaattggatcttgggggcggttcccccatgctgttcttgtgatagttctcacgagatctgatgattttataagtttgatagttcctcctgtgttcattctccttcctgccaccttgtgaagatgccttggttcctcttcactgtctgccatgattgtaagtttcctgaggcctccccagccatgtggaacagtgagtcaattaaacctctttcctttataaattatccagtcttgggcaattcttgatagcagtgtgaaaatggactaatacacttgtgtttatctgtaatttaaatttcatgtctttttctccttgccttacatagggtaaagaccaagaaatgccaaacgtgaactaaaatatgtagggccttcaacttttttacttcctccagtatcttaggaccatcgtaattcttgttagcatctctaaccaggaggcagctgagggaggagggaaagaagactgtaaaaatccccctcactaatgatcaactttggaataaagtgatgcccttcaaatctctgcctcatttacttctggagggcaaaaataattggtagagtaggtaaaaaaaacatgggacaacgtgaaactatgtgggtaaatgtgactgattattccaggccctgttatgtagaatgatttccgtttattctatataaaacacttggaagtttccacactaggcaaagatactaatactggactagacagtacagctcatagctgcaattattcctgtaatataccagcatatggttttcaaaaaagttcagatcctatagcaaactggcctgagaaaacagtcatctagctatcagaaacaaggttttttttggtattaagtactcaaaatttgttgaatatagtcttctctataagaaaatcagattgctgaggcaggagaatcggttgaacccgggaggcggaggttgcagtgagctgagatggtgacactgcaccccagcctgggagacagagcgagactctgtctcaaaa

SEQ ID NO: 287648 - DNA, 4811 bp, Homo sapiens
cccagatcccatcctccggaaagggttagtcaggcaagtgtgctgagaggcccctgggaacctcgtctcgattaacccatcagaaagcagcccatcctttgcacccagctctcagatggaaaagtgaagcccagaaggaagggacctgacacggaggcttccttggtagcatttcagtctcaagggaagaactgtgggcctcccctggagcactggtgaagtaaggggttggtttggatattgtctcctgactgggatatgggcaggactgacagggagctggagtcctaacgaagcctgggctaggtgcaggaagaaccaacccagtggtctcctgacatctcccacgcccccaccgcagctgggtcacctccagaatacggaggagagagctggaggtggaggaactaaggaccttctttgccaggtggggacttaaagtaactggtgcccctacccaatgtccaagctggtcaccttactagctctttgcaaaacagagaaattcctcatccactcgcagcagccgtgtccgcagggagctccagactgccagaaagtcaaagtcatgtaccgcatggcccacaagccagtgtaccaggtcaagcagaaggtgctgacctctttggcctggaggtgctgccctggctacacgggccccaactgcgagcaccacgattccatggcaatccctgagcctgcagatcctggtgacagccaccaggaacctcaggatggaccagtcagcttcaaacctggccaccttgctgcagtgatcaatgaggttgaggtgcaacaggaacagcaggaacatctgctgggagatctccagaatgatgtgcaccgggtggcagacagcctgccaggcctgtggaaagccctgcctggtaacctcacagctgcagtgatggaagcaaatcaaacagggcacgagttccctgatagatccttggagcaggtgctgctaccccacgtggacaccttcctacaagtgcatttcagccccatctggaggagctttaaccaaagcctgcacagccttacccaggccataagaaacctgtctcttgacgtggaggccaaccgccaggccatctccagagtccaggacagtgccgtggccagggctgacttccaggagcttggtgccaaatttgaggccaaggtccaggagaacactcagagagtgggtcagctgcgacaggacgtggaggaccgcctgcacgcccagcactttaccctgcaccgctcgatctcagagctccaagccgatgtggacaccaaattgaagaggctgcacaaggctcaggaggccccagggaccaatggcagtctggtgttggcaacgcctggggctggggcaaggcctgagccggacagcctgcaggccaggctgggccagctgcagaggaacctctcagagctgcacatgaccacggcccgcagggaggaggagttgcagtacaccctggaggacatgagggccaccctgacccggcacgtggatgagatcaaggaactgtactccgaatcggacgagactttcgatcagattagcaaggtggagcggcaggtggaggagctgcaggtgaaccacacggcgctccgtgagctgcgcgtgatcctgatggagaagtctctgatcatggaggagaacaaggaggaggtggagcggcagctcctggagctcaacctcacgctgcagcacctgcagggtggccatgccgacctcatcaagtacgtgaaggactgcaattgccagaagctctatttagacctggacgtcatccgggagggccagagggacgccacgcgtgccctggaggagacccaggtgagcctggacgagcggcggcagctggacggctcctccctgcaggccctgcagaacgccgtggacgccgtgtcgctggccgtggacgcgcacaaagcggagggcgagcgggcgcgggcggccacgtcgcggctccggagccaagtgcaggcgctggatgacgaggtgggcgcgctgaaggcggccgcggccgaggcccgccacgaggtgcgccagctgcacagcgccttcgccgccctgctggaggacgcgctgcggcacgaggcggtgctggccgcgctcttcggggaggaggtgctggaggagatgtctgagcagacgccgggaccgctgcccctgagctacgagcagatccgcgtggccctgcaggacgccgctagcgggctgcaggagcaggcgctcggctgggacgagctggccgcccgagtgacggccctggagcaggcctcggagcccccgcggccggcagagcacctggagcccagccacgacgcgggccgcgaggaggccgccaccaccgccctggccgggctggcgcgggagctccagagcctgagcaacgacgtcaagaatgtcgggcggtgctgcgaggccgaggccggggccggggccgcctccctcaacgcctcccttgacggcctccacaacgcactcttcgccactcagcgcagcttggagcagcaccagcggctcttccacagcctctttgggaacttccaagggctcatggaagccaacgtcagcctggacctggggaagctgcagaccatgctgagcaggaaagggaagaagcagcagaaagacctggaagctccccggaagagggacaagaaggaagcggagcctttggtggacatacgggtcacagggcctgtgccaggtgccttgggcgcggcgctctgggaggcaggatcccctgtggccttctatgccagcttttcagaagggacggctgccctgcagacagtgaagttcaacaccacatacatcaacattggcagcagctacttccctgaacatggctacttccgagcccctgagcgtggtgtctacctgtttgcagtgagcgttgaatttggcccagggccaggcaccgggcagctggtgtttggaggtcaccatcggactccagtctgtaccactgggcaggggagtggaagcacagcaacggtctttgccatggctgagctgcagaagggtgagcgagtatggtttgagttaacccagggatcaataacaaagagaagcctgtcgggcactgcatttgggggcttcctgatgtttaagacctgaaccccagccccaatctgatcagacatcatggactcgcccagctctcctcggcctggggctctggccaaggatgggctggaggtcattcagttggtctgtctcttccctggaaaccttctgcaaagatggtgtggtgtacgtggcttccctgtaaccacatggggcttggccatttctccatgatgagaaggactggaatgcttctccgggcaggacatggtcctaggaagcctgaaccttggcttggcatgccttctcagacagcacggcctgggctccaactcttcaccacaccctgtattctacaacttctttggtgttttgctcctcctgtggttggaaacttctgtacaacactttaaacttttctcttgcttcctcttctcttctcccttatcgtatgatagaaagacattcttccccaggaggaatgtttaaaatggaggcaacattttggccaacattggaaagcactagagggcaatgggattaaaccaacctgcttggtctctattagtcagtaatgaagacgacagcctggccaaccaagggaaaggaaattagtatctttagtttcagtcattccttgtaggatatggtttagctgtgcccccacctaaaatatcatcttgaattgtaatccctataatccccacatcaagggagagatcaggtggaggtaattggatcttgggggcggttcccccatgctgttcttgtgatagttctcacgagatctgatgattttataagtttgatagttcctcctgtgttcattctccttcctgccaccttgtgaagatgccttggttcctcttcactgtctgccatgattgtaagtttcctgaggcctccccagccatgtggaacagtgagtcaattaaacctctttcctttataaattatccagtcttgggcaattcttgatagcagtgtgaaaatggactaatacacttgtgtttatctgtaatttaaatttcatgtctttttctccttgccttacatagggtaaagaccaagaaatgccaaacgtgaactaaaatatgtagggccttcaacttttttacttcctccagtatcttaggaccatcgtaattcttgttagcatctctaaccaggaggcagctgagggaggagggaaagaagactgtaaaaatccccctcactaatgatcaactttggaataaagtgatgcccttcaaatctctgcctcatttacttctggagggcaaaaataattggtagagtaggtaaaaaaaacatgggacaacgtgaaactatgtgggtaaatgtgactgattattccaggccctgttatgtagaatgatttccgtttattctatataaaacacttggaagtttccacactaggcaaagatactaatactggactagacagtacagctcatagctgcaattattcctgtaatataccagcatatggttttcaaaaaagttcagatcctatagcaaactggcctgagaaaacagtcatctagctatcagaaacaaggttttttttggtattaagtactcaaaatttgttgaatatagtcttctctataagaaaatcagattgctgaggcaggagaatcggttgaacccgggaggcggaggttgcagtgagctgagatggtgacactgcaccccagcctgggagacagagcgagactctgtctcaaaa

SEQ ID NO: 287649 - DNA, 3975 bp, Homo sapiens
gcttctaagctcctgctcagaggacatcagcagctaacttccctgctctcagccttcaactctccttctctgaaccttgtgatcttcccaggcctgagttccctgatagatccttggagcaggtgctgctaccccacgtggacaccttcctacaagtgcatttcagccccatctggaggagctttaaccaaagcctgcacagccttacccaggccataagaaacctgtctcttgacgtggaggccaaccgccaggccatctccagagtccaggacagtgccgtggccagggctgacttccaggagcttggtgccaaatttgaggccaaggtccaggagaacactcagagagtgggtcagctgcgacaggacgtggaggaccgcctgcacgcccagcactttaccctgcaccgctcgatctcagagctccaagccgatgtggacaccaaattgaagaggctgcacaaggctcaggaggccccagggaccaatggcagtctggtgttggcaacgcctggggctggggcaaggcctgagccggacagcctgcaggccaggctgggccagctgcagaggaacctctcagagctgcacatgaccacggcccgcagggaggaggagttgcagtacaccctggaggacatgagggccaccctgacccggcacgtggatgagatcaaggaactgtactccgaatcggacgagactttcgatcagattagcaaggtggagcggcaggtggaggagctgcaggtgaaccacacggcgctccgtgagctgcgcgtgatcctgatggagaagtctctgatcatggaggagaacaaggaggaggtggagcggcagctcctggagctcaacctcacgctgcagcacctgcagggtggccatgccgacctcatcaagtacgtgaaggactgcaattgccagaagctctatttagacctggacgtcatccgggagggccagagggacgccacgcgtgccctggaggagacccaggtgagcctggacgagcggcggcagctggacggctcctccctgcaggccctgcagaacgccgtggacgccgtgtcgctggccgtggacgcgcacaaagcggagggcgagcgggcgcgggcggccacgtcgcggctccggagccaagtgcaggcgctggatgacgaggtgggcgcgctgaaggcggccgcggccgaggcccgccacgaggtgcgccagctgcacagcgccttcgccgccctgctggaggacgcgctgcggcacgaggcggtgctggccgcgctcttcggggaggaggtgctggaggagatgtctgagcagacgccgggaccgctgcccctgagctacgagcagatccgcgtggccctgcaggacgccgctagcgggctgcaggagcaggcgctcggctgggacgagctggccgcccgagtgacggccctggagcaggcctcggagcccccgcggccggcagagcacctggagcccagccacgacgcgggccgcgaggaggccgccaccaccgccctggccgggctggcgcgggagctccagagcctgagcaacgacgtcaagaatgtcgggcggtgctgcgaggccgaggccggggccggggccgcctccctcaacgcctcccttgacggcctccacaacgcactcttcgccactcagcgcagcttggagcagcaccagcggctcttccacagcctctttgggaacttccaagggctcatggaagccaacgtcagcctggacctggggaagctgcagaccatgctgagcaggaaagggaagaagcagcagaaagacctggaagctccccggaagagggacaagaaggaagcggagcctttggtggacatacgggtcacagggcctgtgccaggtgccttgggcgcggcgctctgggaggcaggatcccctgtggccttctatgccagcttttcagaagggacggctgccctgcagacagtgaagttcaacaccacatacatcaacattggcagcagctacttccctgaacatggctacttccgagcccctgagcgtggtgtctacctgtttgcagtgagcgttgaatttggcccagggccaggcaccgggcagctggtgtttggaggtcaccatcggactccagtctgtaccactgggcaggggagtggaagcacagcaacggtctttgccatggctgagctgcagaagggtgagcgagtatggtttgagttaacccagggatcaataacaaagagaagcctgtcgggcactgcatttgggggcttcctgatgtttaagacctgaaccccagccccaatctgatcagacatcatggactcgcccagctctcctcggcctggggctctggccaaggatgggctggaggtcattcagttggtctgtctcttccctggaaaccttctgcaaagatggtgtggtgtacgtggcttccctgtaaccacatggggcttggccatttctccatgatgagaaggactggaatgcttctccgggcaggacatggtcctaggaagcctgaaccttggcttggcatgccttctcagacagcacggcctgggctccaactcttcaccacaccctgtattctacaacttctttggtgttttgctcctcctgtggttggaaacttctgtacaacactttaaacttttctcttgcttcctcttctcttctcccttatcgtatgatagaaagacattcttccccaggaggaatgtttaaaatggaggcaacattttggccaacattggaaagcactagagggcaatgggattaaaccaacctgcttggtctctattagtcagtaatgaagacgacagcctggccaaccaagggaaaggaaattagtatctttagtttcagtcattccttgtaggatatggtttagctgtgcccccacctaaaatatcatcttgaattgtaatccctataatccccacatcaagggagagatcaggtggaggtaattggatcttgggggcggttcccccatgctgttcttgtgatagttctcacgagatctgatgattttataagtttgatagttcctcctgtgttcattctccttcctgccaccttgtgaagatgccttggttcctcttcactgtctgccatgattgtaagtttcctgaggcctccccagccatgtggaacagtgagtcaattaaacctctttcctttataaattatccagtcttgggcaattcttgatagcagtgtgaaaatggactaatacacttgtgtttatctgtaatttaaatttcatgtctttttctccttgccttacatagggtaaagaccaagaaatgccaaacgtgaactaaaatatgtagggccttcaacttttttacttcctccagtatcttaggaccatcgtaattcttgttagcatctctaaccaggaggcagctgagggaggagggaaagaagactgtaaaaatccccctcactaatgatcaactttggaataaagtgatgcccttcaaatctctgcctcatttacttctggagggcaaaaataattggtagagtaggtaaaaaaaacatgggacaacgtgaaactatgtgggtaaatgtgactgattattccaggccctgttatgtagaatgatttccgtttattctatataaaacacttggaagtttccacactaggcaaagatactaatactggactagacagtacagctcatagctgcaattattcctgtaatataccagcatatggttttcaaaaaagttcagatcctatagcaaactggcctgagaaaacagtcatctagctatcagaaacaaggttttttttggtattaagtactcaaaatttgttgaatatagtcttctctataagaaaatcagattgctgaggcaggagaatcggttgaacccgggaggcggaggttgcagtgagctgagatggtgacactgcaccccagcctgggagacagagcgagactctgtctcaaaa

SEQ ID NO: 287650 - DNA, 2368 bp, Homo sapiens
aagacaacgtcactagcagtttctggagctacttgccaaggctgagtgtgagctgagcctgccccaccaccaagatgatcctgagcttgctgttcagccttgggggccccctgggctgggggctgctgggggcatgggcccaggcttccagtactagcctctctgatctgcagagctccaggacacctggggtctggaaggcagaggctgaggacaccagcaaggaccccgttggacgtaactggtgcccctacccaatgtccaagctggtcaccttactagctctttgcaaaacagagaaattcctcatccactcgcagcagccgtgtccgcagggagctccagactgccagaaagtcaaagtcatgtaccgcatggcccacaagccagtgtaccaggtcaagcagaaggtgctgacctctttggcctggaggtgctgccctggctacacgggccccaactgcgagcaccacgattccatggcaatccctgagcctgcagatcctggtgacagccaccaggaacctcaggatggaccagtcagcttcaaacctggccaccttgctgcagtgatcaatgaggttgaggtgcaacaggaacagcaggaacatctgctgggagatctccagaatgatgtgcaccgggtggcagacagcctgccaggcctgtggaaagccctgcctggtaacctcacagctgcagtgatggaagcaaatcaaacagggcacgagttccctgatagatccttggagcaggtgctgctaccccacgtggacaccttcctacaagtgcatttcagccccatctggaggagctttaaccaaagcctgcacagccttacccaggccataagaaacctgtctcttgacgtggaggccaaccgccaggccatctccagagtccaggacagtgccgtggccagggctgacttccaggagcttggtgccaaatttgaggccaaggtccaggagaacactcagagagtgggtcagctgcgacaggacgtggaggaccgcctgcacgcccagcactttaccctgcaccgctcgatctcagagctccaagccgatgtggacaccaaattgaagaggctgcacaaggctcaggaggccccagggaccaatggcagtctggtgttggcaacgcctggggctggggcaaggcctgagccggacagcctgcaggccaggctgggccagctgcagaggaacctctcagagctgcacatgaccacggcccgcagggaggaggagttgcagtacaccctggaggacatgagggccaccctgacccggcacgtggatgagatcaaggaactgtactccgaatcggacgagactttcgatcagattagcaaggtggagcggcaggtggaggagctgcaggtgaaccacacggcgctccgtgagctgcgcgtgatcctgatgattttataagtttgatagttcctcctgtgttcattctccttcctgccaccttgtgaagatgccttggttcctcttcactgtctgccatgattgtaagtttcctgaggcctccccagccatgtggaacagtgagtcaattaaacctctttcctttataaattatccagtcttgggcaattcttgatagcagtgtgaaaatggactaatacacttgtgtttatctgtaatttaaatttcatgtctttttctccttgccttacatagggtaaagaccaagaaatgccaaacgtgaactaaaatatgtagggccttcaacttttttacttcctccagtatcttaggaccatcgtaattcttgttagcatctctaaccaggaggcagctgagggaggagggaaagaagactgtaaaaatccccctcactaatgatcaactttggaataaagtgatgcccttcaaatctctgcctcatttacttctggagggcaaaaataattggtagagtaggtaaaaaaaacatgggacaacgtgaaactatgtgggtaaatgtgactgattattccaggccctgttatgtagaatgatttccgtttattctatataaaacacttggaagtttccacactaggcaaagatactaatactggactagacagtacagctcatagctgcaattattcctgtaatataccagcatatggttttcaaaaaagttcagatcctatagcaaactggcctgagaaaacagtcatctagctatcagaaacaaggttttttttggtattaagtactcaaaatttgttgaatatagtcttctctataagaaaatcagattgctgaggcaggagaatcggttgaacccgggaggcggaggttgcagtgagctgagatggtgacactgcaccccagcctgggagacagagcgagactctgtctcaaaa

SEQ ID NO: 287651 - DNA, 644 bp, Homo sapiens
cccaggctggagtgtggtggcaagatcagagctcactgcagcctccaactttctggctcaagtgatcctcccacctcagcaccccaagcagctgggaccacaggtgtggactaacacacctggctgtttttttttatttttagtagagatgaggtcttactatgttgcctaggctgatttcgaattcctgggcttaagcgatcctccctccttggcctctcaaagtgctgggattacaggcatggtggcgggcgcctgtagtcccagctactcgggaggctgaggcaggagaatggcatgaacccgggaggcggagcttgcaatgagccgagatcgcgccactgcactccagcctgggcgacagagcaagtctctaaaatggacaggaggcatccctgtgatattaggggtaatatcacggcacatcagaaactatccaccaattagtacccggagaatctagtcctgcagggcaagaggatgacagcagacgacacctggggtccagctgaggagaaagccaggacccgccccctcgagaccctgcccttcaaaacaccacttccagaccttgccctcaagatgacgatcaccctctggcccggcctccaggcagcctcctcattcttgccccgcccagattc

SEQ ID NO: 287652 - DNA, 690 bp, Homo sapiens
cggatgcgtgactctacctgctcaaaaaaggcgctttgcattaaaaccattttcaacttaagaggaaaaacgattcagcgttcagtacaggtggcccaacacaatatgttgttttaccttcgattgtttgaaatattaacttaggggccgggcgcggtggctcgcgcctgtaatcccagcactttgggaggccgaggcgggcggatcacgaggtcaggagatcgagaccatcctggctaacacagtgaaaccccgtctctactgaaaatacaaaaaattagccaggcatggtggcgggcgcctgtagtcccagctactcgggaggctgaggcaggagaatggcatgaacccgggaggcggagcttgcaatgagccgagatcgcgccactgcactccagcctgggcgacagagcaagtctctaaaatggacaggaggcatccctgtgatattaggggtaatatcacggcacatcagaaactatccaccaattagtacccggagaatctagtcctgcagggcaagaggatgacagcagacgacacctggggtccagctgaggagaaagccaggacccgccccctcgagaccctgcccttcaaaacaccacttccagaccttgccctcaagatgacgatcaccctctggcccggcctccaggcagcctcctcattcttgccccgcccagattc

SEQ ID NO: 287653 - DNA, 689 bp, Homo sapiens
gtgtgtgttctggaagggtggggaagggaggttaaaaatcaaagctgagctccagtgagtagggatggggttcgccttgctgccctgtgaaaggagaagggacagattgagtcagagttcctcagaaatgttgtgccctaaacccccaagacagaaacatctgtctactgcagctaacacattttggtaaagcattaacattccactgggatgggatagcctccatagaatcacctctaccagtgactgtcttcacaattcttcaacatcaatagatgactaaaattaactaaattcatgtcaatatgcccttgagggtctcaaaaagagtatatcccaaatgttcatcttgataatgagcagtttgggcaaagaaaatacagaaaaaccgggccaacaaatagagatgaaatagtgagcaaatgtcaaatactgagattataaaacctaagcagattcatgggttttaaacttaaaaaagtccgtggagtttttgctatgagtaatagactgaaggtgaatggcctaccatgaagatctatactagagatgactcatctattctcaaaaccagtgagtgatcaaaccacaagacctaataggttctactgttaggggaaaagatgttttaaataaggagcacattattccactcactgacaaaacgaaaatacagatggaattaaaaa

SEQ ID NO: 287654 - DNA, 1207 bp, Homo sapiens
  misc_feature (355)..(355): n is a, c, g, or t
tatatctagaaatcaacttttagcctattcttactgacctagagaataataagctctttaaatgacacccttaatgaaaactgtcacataattttcctctaaagtcagcgatattttttaacaatcatattctttatagaattcctaaatctgggtttttgaaaaaagaaactagtgaccatttaaaattgttggctctattcccactgcttctagtggactagcctgaaaaaaatatttttccatgtctgcgtatattttataccttatataatgtcctctctgaaatcatggaggaatttaagaaggagaaaattgataatcatacttacttagtttctttgggaatatttgncatttagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggtgtgtgttttggtttggtttggttctgctttctggtaactacaaattattaattaggtgagaattttgaacataaagcatgatgattatatataaccctactatgtcaaggttcaaaatagtaatgttaaaaatgaaatttggggccaggtgcagtggctcacgcctgtaatcccagcatgttgggaagccaaagcaggtggattgcctgagctcaggagttcgagaccagcctgggcaacatggcgaaaccccatctctactaaaaaaatataaaaaattagccggatttggtggcatgcacctgtagtcccagctggtcgggaggctgaggtaggaggatcacttgagcctgggagttggaggctgcagtcagccaagatcacaccactgagctccaacctgagtgacagtgagaccctgtctcaaaaaaaaaaatgtccttgtcacattttatattataaatcgttgctacagctgcttcagtagacattgaagcaaaggcagtacttaagcctagatcttacctctgtgggtaacaacagccagatattaggagatgggactttggctgagtcctgggaaacaggtggagtcaggacatccaggaatgtgtgaactgggaccggga

SEQ ID NO: 287655 - DNA, 1090 bp, Homo sapiens
gggtgaggagcagagcacctggacagacctgcacaggaaggagcctgcagcctgcggggtggggtcacttactgggctcctattggctggatgcagtgggattaggggtcagggttctcactccttctgactctggggtctgagaaaacacagcaacgaggtgaatgacatgggagacagacctggggtctttcagggacggaaagcctcagccaagacccagactcccagggtcatcaacctcctcgggtcactaaccctccccagtgtctgtctacccctaagtccagagaacacgtcctctctaggctcgagccggaatcaatataggctacaagggcatcagttcaggctgcgcggaggagagaaggaagtgctgatgtggaggtaagagggtggccctgtcagaacctccggattcgaatcccggctctgccactcccagtgtgaccttgccccagttagttactacatttggcctcaattttctatctgcagggggactaaacgcgggggaataggggatccccaaaatttttgacagctctccagtaagaggagggtagcagagcatggctgtttccctccacaatttaaaaacaaacacaaagattggtgccgtcgcttctctcctctactcagtctccgtgtaggtcccacgagtggagaaagggagaggagagcggtcccacaatcttctcccgttctcccccgacggcccgcgaaggcaagcgccatcgggaagggatgggtaggacagaggagaccggccgggcccagcacccggaacccgtccctacgagtccctacgcagcccgtccgcgtggagactgacacccttgcgtggccggtgccaagcgccccggaccttgcacacaacctcgcgcgcaccccaaacacgccctgcagctcttggagcctcagcctttgtgcgcagcaaccgagcgcccgctccgtgctggccctttcccccgagcctccagctccaggggacgcggatcaatcacaccgcccgccggcccggctggcgccttccaggccctacggcccctcgcctgcccctccccctacctgctgccgccgcggccgc

SEQ ID NO: 287656 - DNA, 698 bp, Homo sapiens
gggtgaggagcagagcacctggacagacctgcacaggaaggagcctgcagcctgcggggtggggtcacttactgggctcctattggctggatgcagtgggattaggggtcagggttctcactccttctgactctggggtctgagaaaacacagcaacgaggtgaatgacatgggagacagacctggggtctttcagggacggaaagcctcagccaagacccagactcccagggtcatcaacctcctcgggtcactaaccctccccagtgtctgtctacccctaagtccagagaacacgtcctctctaggctcgagccggaatcaatataggctacaagggcatcagttcaggctgcgcggaggagagaaggaagtgctgatgtggaggatccgtgaggttcatctatctgtagtgcttctggccagagaaaaggccgaagagagaaaaccctgaggaacatctttgacctgcatagaaacttatctgaagattttcagaatctgagcctcaccctcagtctatcccagttttatcctgacctgtccacatctgttatactccaaggcttgctgggcccaacactggaagctatttaatgtttctattgcgactggccttttaaagccagtgggattctccatgctacacttgagcctggagactagaaaacatgacagcctgttttcattaatccgtt

SEQ ID NO: 287657 - DNA, 986 bp, Homo sapiens
  misc_feature (821)..(821): n is a, c, g, or t
  misc_feature (823)..(823): n is a, c, g, or t
  misc_feature (832)..(833): n is a, c, g, or t
  misc_feature (836)..(837): n is a, c, g, or t
  misc_feature (843)..(843): n is a, c, g, or t
  misc_feature (845)..(845): n is a, c, g, or t
  misc_feature (849)..(849): n is a, c, g, or t
  misc_feature (851)..(851): n is a, c, g, or t
  misc_feature (854)..(854): n is a, c, g, or t
  misc_feature (857)..(858): n is a, c, g, or t
aaattacggctagtagaggctgggtgttgaatcggccgaggcctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggctgaccaaggacgcacacaacgccctgctggacatccagtcgagtggcgagccaggagcttctgggccagggctgtgtgngnactgagganngannggagcngnaagngnggngcnnaggccttcactgcataacggatgagggtgtaacggttgccagctgaatccatggcatgaaatcggtaaaaataccaaggggggaccggggcccatgacgtccgcaagggcaaacacaggcgggcgacc

SEQ ID NO: 287658 - DNA, 471 bp, Homo sapiens
tcgctcgcccacgcgcagctggtggtggaactgcttgctgatcatgcgtcggcgggcatcgctctcatgggcggccatgtaggggatctccaggagcatggcagacaccaggtagacacactccagcagctccaggttgatgtgcaggtggaaggggacctgacggcgccgctccaccttctcctgctcctggttgcgctcctgcaggctgcgcagcagcaggccctggcccagaagctccttggctcggccactcgactggatgtccagcagggcgttgtgtgcgtccttggtcaggccttggcggaaggcacagatgcccagctgcaccatggtgcggttgtaaaggattctgcactcgcgctggtaccaggcccgcgacctcatgctcatgagccacttgcaggacaacattcagcatgcagacccgccagtgcagatcctctgagtcgaccgatccttgagtcgacg

SEQ ID NO: 287659 - DNA, 1043 bp, Homo sapiens
aaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggctgaccaaggacgcacacaacgccctgctggacatccagtcgagtggcgagccaggagcttctgggccagggctggtgtggcccgggggcaccggacggagaggggggggacagacc

SEQ ID NO: 287660 - DNA, 1291 bp, Homo sapiens
aaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggctgaccaaggacgcacacaacgccctgctggacatccagtcgagtggcgagccaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgccatgagagcgatgcccgccgacgcatgatcagcaagcagttccaccaccagctgcgcgtgggcgagcgacagccctggtggtccccctgagtcatgcgggactgtggtcgctgctcccaggctagtggtgactggacccg

SEQ ID NO: 287661 - DNA, 1171 bp, Homo sapiens
  misc_feature (1006)..(1006): n is a, c, g, or t
  misc_feature (1008)..(1008): n is a, c, g, or t
  misc_feature (1017)..(1018): n is a, c, g, or t
  misc_feature (1021)..(1022): n is a, c, g, or t
  misc_feature (1028)..(1028): n is a, c, g, or t
  misc_feature (1030)..(1030): n is a, c, g, or t
  misc_feature (1034)..(1034): n is a, c, g, or t
  misc_feature (1036)..(1036): n is a, c, g, or t
  misc_feature (1039)..(1039): n is a, c, g, or t
  misc_feature (1042)..(1043): n is a, c, g, or t
aaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggctgaccaaggacgcacacaacgccctgctggacatccagtcgagtggcgagccaggagcttctgggccagggctgtgtgngnactgagganngannggagcngnaagngnggngcnnaggccttcactgcataacggatgagggtgtaacggttgccagctgaatccatggcatgaaatcggtaaaaataccaaggggggaccggggcccatgacgtccgcaagggcaaacacaggcgggcgacc

SEQ ID NO: 287662 - DNA, 1037 bp, Homo sapiens
cgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggctgaccaaggacgcacacaacgccctgctggacatccagtcgagtggcgagccaggagcttctgggccagggctggtgtggcccgggggcaccggacggagaggggggggacagacc

SEQ ID NO: 287663 - DNA, 858 bp, Homo sapiens
aaattacggctagtagaggctgggtgttgaatcggccgaggcctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggctgaccaaggacgcacacaacgccctgctggacatccagtcgagtggcgagccaggagcttctgggccagggctggtgtggcccgggggcaccggacggagaggggggggacagacc

SEQ ID NO: 287664 - DNA, 814 bp, Homo sapiens
cgtcctgagggctcagcgccagcgcctgctggtagtccgcctcggcaaaggccaggttgcccagctggaagaagcaatctagggtccggaggcgggggtgagtggacccccaactcccagtgcccgggagccccagcccagccggctccagcccgggggccagggcctgaaactggtggctgataaccccccgccgcagtctccgtcctctctagttttctgggcgtctgggcactgttccccagctgcctgttttgagcattttaaggagtctggagccagtttgtctaaggcaacatttcccaaaggccttcccagctcccacttccggctactgacaccccaagctttgatgtctccagctcaggcctggtcccaagtctcaggccttgggggtcctacagtcccttgggtaaccttcaggaccctcactccagcaggccacactgagcacctcacctgacttctgccccaggttctcccattttggtgaggtcaccttccccaccagctacccaagccagagacctctgtccaagcagccgccgagccttacaaggatctttcacatgcctggttcttggcatggcggccagggccttccctgagtcggactgctgcccctgcctctcccggccttcaccctttcctgcgaacccagcctcggtctctctgcctggccctctgcctttgcgttagtcttctcccaagcccgcacctcgtccgaatctgtcatgaggccccttccaggaggaccccgaggcctctgccaactacctcgcggccctggccctgacgttgctaggcaccatca

SEQ ID NO: 287665 - DNA, 477 bp, Homo sapiens
agcagaaggggcaccttgcaaccctcgacctggagcgcctcacgctaaacctggcgacccccacctggacggcctcccaccaaaccctcgcatcccccacaggccttagtttcccatttgtcctagaggcgcagaaccaaacaccctttccaggtgcctttctagtcttggtacctgcccctcggccagggagtgaccgctctctgcgtcgcggccgttagggacgacccccaggcggcagccatcttcctccacaagctccgcccctcgcgtctcccccgtttctcacccggggcctcgggaggcggagagaacgaacaggaggccgggacttcacggaggccccgcccccccaacatgcctattgggtagtgcgggaggagaaggtgtctgattggctaggaatgctccagacggcagcggcggggacgcacccaggaagccggagaggtttgtcttgtgaccgcgggcggccgc

SEQ ID NO: 287666 - DNA, 1450 bp, Homo sapiens
cgtcctggtgatggtgcctagcaacgtcagggccagggccgcgaggtagttggcagaggcctcggggtcctcctggaaggggcctcatgacagattcggacgaggatgccctgaaggttgaccagggcccctcacgggacatcccaaagccatgggtgattccagcccccaaagggatcctgcagcacatctttgggaccagccacgtgttccaaagcatctgtgatgtaaaaccaaaggtcacagggttaacagtgcccctcaaagtcagggaatactactccagaggccagcagtgcttggagcaggcagactgggagacagctgtgctgctcttctcccgcgcactccacctggacccacagctggtggacttctatgccttacgggctgaggcctacctccagctctgtgacttctcctcggccgcccagaacctgcgaagggcctactcattacagcaggacaactgcaagcacctggagcgcctcacctttgtgctctacctacagggacaatgcctttttgagcagtgtgccttcctggatgccctgaatgtcttctcacatgctgctgagctccagcctgagaaaccatgcttccgttaccgatgcatggcctgtctcctggccctcaagcagcatcaggcctgcctcacgctcatcaccaacgagctgaagcaggacaccaccaacgccgatgtctacatcttccgggccagactctacaactttctccagaagccccacctctgctaccgggacctgcacagcgccttgctgttgaatcccaagcacccgcaggccaggatgctgctccagaagatggtggcccaggcccagcaggcgcgccaagatgcggggatcctggctgtgcagggcaagctgcagcacgcactgcagcggatcaaccgtgccatcgagaacaaccctctggaccccagtctcttcctcttccggggcaccatgtaccgacggctccaggagttcgatggggcagtggaggacttcctgaaggtgctggacatggtgaccgaggaccaggaggacatggtgcggcaggcacagcgccagctgttgctgacctacaacgactttgccgtgcactgctacaggcagggcgcctaccaggagggcgtgctgctgctgaacaaggccctccgggacgagcagcaggagaaaggactctacatcaaccgaggcggtgcgcagcgaccagggcactggggagggggggtgcgggggagcctcgccatctctaaggcccccactgggcacttgaggcccctggggggaaggaggaagggagagaggaaggaagcaagggaagaggaaatgtaatagtctcagtatcccaggaacacactttgggaaatgttgccttagacaaactggctccagactccttaaaatgctcaaaacaggcagctggggaacagtgcccagacgcc

SEQ ID NO: 287667 - DNA, 5160 bp, Homo sapiens
cccagcccaagtttttagggtggggatccagactggttatacgtaccttcagtccttctcccagaggaaggcagaaacacctcaaagcctgcatgtaagaacatctactgagaaattattttaatcagacaccagctgagtgggagaaaggaaaagaacagagaagaacaaacaaaactcccttggtcttggatgtaagagaatccagcagagatggactggagtttcttcagagtagttgcagtgctgttcatttttctggtggtggtagaagttaacagtgaattccgaatccaggtaagagattataacactaaaaatggcaccatcaaatggcattcaatccgaaggcagaaacgtgaatggatcaagttcgcagcagcctgtcgtgaaggtgaagacaactcaaagaggaacccaatcgccaaaattcactcagattgtgctgcaaaccagcaagttacataccgcatctctggagtaggaattgatcagccaccatatgggatctttgtcattaatcagaaaactggtgaaattaatataacatccatagttgatcgagaggtcactcctttcttcattatctactgccgagctctgaactcaatgggccaagatttagagaggcctctagagctcagagtcagggttttggatataaatgacaaccctccagtgttttcaatggctacatttgcaggacaaatagaagaaaattctaatgcaaatacactggtgatgatactcaatgctactgacgcagatgaaccgaacaatttgaactcaaaaatagccttcaagattataagacaagaaccttcagattcaccaatgtttattatcaacagaaatactggagaaattcgaacgatgaataattttctagacagagagcaatacggccagtatgctcttgctgtaagaggctctgaccgagatggtggggcagatggcatgtcagcggaatgtgagtgcaacattaaaatcctcgatgtcaatgataatatcccttacatggaacagtcttcatataccatagaaattcaagaaaatactctaaattcaaatttgctcgagattagagtaattgatttggatgaagagttctcagctaactggatggcagtaattttctttatctctggaaatgaaggaaattggtttgagatagaaatgaatgaaagaacaaatgtgggaattttaaaggttgttaagcccttagattatgaagctatgcagagtctgcaactcagtattggtgtcagaaataaagctgaatttcatcattcaattatgtctcaatataaactgaaagcatctgcaatttctgtgactgtgttaaatgtaattgaaggcccagtgtttcgtccaggttcaaagacatatgttgtaactggtaatatgggatcaaatgataaagtgggagactttgtagctactgacctggacacaggtagaccttcaacgactgttaggtatgtaatgggaaataatccagctgacctgctagctgttgattcaagaacaggcaaactcactttgaaaaataaagttaccaaggaacagtacaatatgctcggaggaaaataccaaggaacgattctctctatagatgataatcttcaaagaacttgcactggtacaattaatattaacattcaaagttttggtaatgacgacaggactaatacagagccgaacactaaaattactaccaatactggcagacaagaaagtacttcttccactaactatgataccagcacaacttctactgactctagccaagtatattcttctgaacccggaaacggagccaaagatttgttatcagacaatgtacattttggtcctgctggcattggactcctcatcatgggattcttggtcttaggattggtcccatttttgatgatctgttgtgattgtggaggtgctcctcgtagtgcagctggctttgagcctgttcccgaatgttcagatggagcaattcattcatgggcagtagaaggaccacagcctgaacccagggatataaccactgtcataccacaaataccacctgataacgcaaatataattgaatgcattgacaactcaggagtttatacaaatgagtatggtggcagagaaatgcaagatctgggaggaggagagagaatgacaggatttgaactaacagagggagttaaaacttcaggaatgcctgagatatgtcaagaatactctggaacattaagaagaaattctatgagggaatgtagagaaggaggtctgaatatgaatttcatggaaagctacttctgtcagaaagcatatgcttacgcagatgaagatgaaggacgcccatctaatgactgtttgctcatatatgacatcgaaggtgtaggttcccctgctggctctgtgggttgttgtagcttcattggagaagacctggatgacagcttcttggataccctgggacctaaatttaagaagttggcagacatcagcctaggaaaagaatcatatccagaccttgatccttcttggccaccacaaagcactgaaccagtttgccttcctcaggaaacagagcccgttgttagtggacacccaccaatctccccacatttcggcactaccacagtaatttctgagagcacctatccctcgggacctggtgtactgcatcctaagcctattctcgatcctctgggctatggtaatgtcactgtgaccgagtcttacaccacctctgacactctgaagccctctgtgcacgttcacgataaccgaccagcatcaaacgtggtagtgacagagagagtggtcggcccaatctctggcgctgatttgcatggaatgttagagatgcctgacttgcgagatgggtcgaatgttatagtgacagaaagggtaatagcaccaagctctagtctacccacctctctgactatccatcatcctagagagtcttcaaatgtggtagtgacagaaagagtaatccaaccaacttccggcatgataggtagtctgagtatgcaccccgagttagccaatgcccacaatgtcattgtgacagagagggttgtttctggtgctggcgtaactggaattagtggcaccactgggatcagcggtggcataggcagcagtggcctggttggcaccagcatgggtgctgggagcggtgccctgagtggagctggcataagtggtggtggcattggcctgagcagcttgggagggacagccagcattggccacatgaggagttcctctgaccatcactttaaccaaaccattgggtccgcctcccctagcacagctcgaagtcgaatcacaaagtatagtaccgtgcaatatagcaagtagtcaggaccccagctcactttttcatagtcattgtggtttagatccaattcccaccactaaaaaactaacaatgtgatttataacgcacaacttcgtgctcaggtcatctaggagcaaggtgagaaatcacaatgagaaaaataaatggaaacaccactgctaggggagagctctccttagcattcataaacttttctcttatattaggactaaggaactaaaacttgaggcagagtcttctttgtgcctgagtggcctgtagtccatctccagcatgtaactggccttacgatggcaattggcatcattctccttgctctgttttgcttttccatatagctcgagcaaaattcaaaaagaactaaatatgcaatatatgttcatatctatgggaaaaatctaaaatgtgtgccagatgccctgttggtttcacagataacataaataaaaattcaaccacagatttatacaagggttaaccattttttttaagtttgactacatagtcaagtccacaagccatcaagcactcctaccttaattattgcactagagaaaataaattccaaattaggaagtgtttcctaggaggaaaattccattagagagtggcaataggatgaggtttcttcagggtaaactagcaatgcctgagcctgaaccttaatgtggggcctcagttaaatctcctgtggagtcaaggattcttctgattctagtgtgtgtttagtgatagatgtagtcttgacgaatattgcttactggtgaggttgaggaatatcacactcgtctttccctttaccactgtggttttgacttaagaaagcaaaactcactaagtttacttctcgaattgaagcaagtgaggcctgacatggttgtcatcactagtggcaaatgaccttccaagtaagcagatgggaactgaattgtgttttcaggttttgtttttagtaggtgatattcattcgtatccagctctttattacatagctctgaagttaaaatgatttacataggccgagctgtggacaaaaaaaaagaagcagcagcttgtagtatgcttaagctttggggaatttttttttaaggggatctaaaaaaatgtttttagaacatgtaaaatgtttaatggtgaaagttggaaaagaattcttctgtaaagtaataccatgctaattattcgcttttagtaagtaaagtagtggttgctttagcaaacctctgctgccattttgcaggaatcaaccaggaacctttagcagaattgacaatatggtgttgataagcatgaaataataatagaaacctattctgctagtttatctcaccctctaatttttctcactagcataaattttaaattcctgatttgatttgtcaataagatcttggcttatatatgctgatttataggtagtgtccaaattatatagtataacatatttttctagtttcaaaatttagtaatgtcctatttatgatatatcatttctgtgtgtttgctatgtagtattacccaattaaaaatctctaaaaagaattaaagcattctaagaaaaaggtaaatttactattgcatggtacagaaattttttctttcttaaatacaatgttactataagctcactaaaatgaaactctatatgacaaaataaaattagaaaaaaatttgccctggagttgtgaattatatacaacttttaaagaatttaccccaattactcaaatttcccaggaaattacaaagccaaagaatattcaacttcctccactggtcaaaagaggataggagtg

SEQ ID NO: 287668 - DNA, 3338 bp, Homo sapiens
agcggagtctttacacatgaaccaagatggccgccatcactcacagtctatgctgttttttgtgctgagaaagctaatggagaaaatgaagaggaatcagaaacacaacaaaattagatggaagtaaccagggaagattttctaagtgaagttcaaattttaaatggatttcagaatttcctaaatagtattttttttttaggaaatctgaggatataaccactgtcataccacaaataccacctgataacgcaaatataattgaatgcattgacaactcaggagtttatacaaatgagtatggtggcagagaaatgcaagatctgggaggaggagagagaatgacaggatttgaactaacagagggagttaaaacttcaggaatgcctgagatatgtcaagaatactctggaacattaagaagaaattctatgagggaatgtagagaaggaggtctgaatatgaatttcatggaaagctacttctgtcagaaagcatatgcttacgcagatgaagatgaaggacgcccatctaatgactgtttgctcatatatgacatcgaaggtgtaggttcccctgctggctctgtgggttgttgtagcttcattggagaagacctggatgacagcttcttggataccctgggacctaaatttaagaagttggcagacatcagcctaggaaaagaatcatatccagaccttgatccttcttggccaccacaaagcactgaaccagtttgccttcctcaggaaacagagcccgttgttagtggacacccaccaatctccccacatttcggcactaccacagtaatttctgagagcacctatccctcgggacctggtgtactgcatcctaagcctattctcgatcctctgggctatggtaatgtcactgtgaccgagtcttacaccacctctgacactctgaagccctctgtgcacgttcacgataaccgaccagcatcaaacgtggtagtgacagagagagtggtcggcccaatctctggcgctgatttgcatggaatgttagagatgcctgacttgcgagatgggtcgaatgttatagtgacagaaagggtaatagcaccaagctctagtctacccacctctctgactatccatcatcctagagagtcttcaaatgtggtagtgacagaaagagtaatccaaccaacttccggcatgataggtagtctgagtatgcaccccgagttagccaatgcccacaatgtcattgtgacagagagggttgtttctggtgctggcgtaactggaattagtggcaccactgggatcagcggtggcataggcagcagtggcctggttggcaccagcatgggtgctgggagcggtgccctgagtggagctggcataagtggtggtggcattggcctgagcagcttgggagggacagccagcattggccacatgaggagttcctctgaccatcactttaaccaaaccattgggtccgcctcccctagcacagctcgaagtcgaatcacaaagtatagtaccgtgcaatatagcaagtagtcaggaccccagctcactttttcatagtcattgtggtttagatccaattcccaccactaaaaaactaacaatgtgatttataacgcacaacttcgtgctcaggtcatctaggagcaaggtgagaaatcacaatgagaaaaataaatggaaacaccactgctaggggagagctctccttagcattcataaacttttctcttatattaggactaaggaactaaaacttgaggcagagtcttctttgtgcctgagtggcctgtagtccatctccagcatgtaactggccttacgatggcaattggcatcattctccttgctctgttttgcttttccatatagctcgagcaaaattcaaaaagaactaaatatgcaatatatgttcatatctatgggaaaaatctaaaatgtgtgccagatgccctgttggtttcacagataacataaataaaaattcaaccacagatttatacaagggttaaccattttttttaagtttgactacatagtcaagtccacaagccatcaagcactcctaccttaattattgcactagagaaaataaattccaaattaggaagtgtttcctaggaggaaaattccattagagagtggcaataggatgaggtttcttcagggtaaactagcaatgcctgagcctgaaccttaatgtggggcctcagttaaatctcctgtggagtcaaggattcttctgattctagtgtgtgtttagtgatagatgtagtcttgacgaatattgcttactggtgaggttgaggaatatcacactcgtctttccctttaccactgtggttttgacttaagaaagcaaaactcactaagtttacttctcgaattgaagcaagtgaggcctgacatggttgtcatcactagtggcaaatgaccttccaagtaagcagatgggaactgaattgtgttttcaggttttgtttttagtaggtgatattcattcgtatccagctctttattacatagctctgaagttaaaatgatttacataggccgagctgtggacaaaaaaaaagaagcagcagcttgtagtatgcttaagctttggggaatttttttttaaggggatctaaaaaaatgtttttagaacatgtaaaatgtttaatggtgaaagttggaaaagaattcttctgtaaagtaataccatgctaattattcgcttttagtaagtaaagtagtggttgctttagcaaacctctgctgccattttgcaggaatcaaccaggaacctttagcagaattgacaatatggtgttgataagcatgaaataataatagaaacctattctgctagtttatctcaccctctaatttttctcactagcataaattttaaattcctgatttgatttgtcaataagatcttggcttatatatgctgatttataggtagtgtccaaattatatagtataacatatttttctagtttcaaaatttagtaatgtcctatttatgatatatcatttctgtgtgtttgctatgtagtattacccaattaaaaatctctaaaaagaattaaagcattctaagaaaaaggtaaatttactattgcatggtacagaaattttttctttcttaaatacaatgttactataagctcactaaaatgaaactctatatgacaaaataaaattagaaaaaaatttgccctggagttgtgaattatatacaacttttaaagaatttaccccaattactcaaatttcccaggaaattacaaagccaaagaatattcaacttcctccactggtcaaaagaggataggagtg

SEQ ID NO: 287669 - DNA, 529 bp, Homo sapiens
atttatgtaaacgttgagccaacttttcaaagaactttacataagacaaagtaaaggctgtctacgtcaagtgtgatattgcctgtaatatgtatttttagcaatacggccagtatgctcttgctgtaagaggctctgaccgagatggtggggcagatggcatgtcagcggaatgtgagtgcaacattaaaatcctcgatgtcaatgataatatcccttacatggaacagtcttcagtaagtatttgttcttggaattaataaatctaaattcgctatattctaaaacatatacgaacaattctgcttacagaggcacatgttatgtttattgacatacaacccaaatgtagacacatacttttttcttgtgtttatgcaagaataaatggagttaagcaatgaaaaatgagatgaaaaccacagatatcttttctaaataatgaagttatcaacattccagtataagcctactgtagttctctctctttcacacagtttgtgctaagagttttcacttcttgtttcag

SEQ ID NO: 287670 - DNA, 950 bp, Homo sapiens
ttttttttttttggaatagacacaaggtcttttctatattgcccaggctggtcttgaactactgggctcaagcgatcctcccacctcccaaagtgctctgattacaggcgtgaaccacagtgcctggctctaaataacatattttgatgaaacataacccaagttttgagaaagtggtgagactagaggcattattttacacttttgcaaatcctctaatatctggcttaacagaggctggattctcctgcgtgcttctacgacacactcttctcgttgcaggacctgaggaagatccacctcacgccaatgtggagttggaaagagagggaccttgaagatgtccttgaaagaatcttaaggaacctcaggggtcctcagaccacactttgagaactgctgcccaagtgtggcttcctggccatgtgaagtggcagagtcggaaatggaagtcagaggggcagctgccaggctcacaccccaccccgtcacccctcagctgcccctggacaggaagctggaactcacctctccattgaggtagatgaggtcgaaggcgtacaaacacacctgcacctggatctcagacgcatccacctcctgggttggggcacaacggagttcgtgagtgcaggaaggtgggacggggcactgtgcctgaggccgacagcattcatctaccggtctccctctcgccacctaactggctgcccatctgtgagggcggcatgctgctggctccaggtgctggatccttaacggctctcagctaattccgacaacctcattccccttcaccagatatttgctctcctagacttttctgcagctaatggcagtgacatggcacagttctggccatgagatggaaaaggggaaacctgtggggtgcaggttgtggggttttccagaacagatcttcttcatagtaaacaacagagatgccgaaa

SEQ ID NO: 287671 - DNA, 845 bp, Homo sapiens
tgtaagatgtgcctttgctcctctttcgccttctgccatgactgtgaggcctccccagccgtgtggaactccccagttccccaggaccttgcatatggcctgcagctcctcactgtcctcgtcgtaggaggccagcaggaagcccccgtaccggccggcccgcttcccccggcccaggacctgaggaagatccacctcacgccaatgtggagttggaaagagagggaccttgaagatgtccttgaaagaatcttaaggaacctcaggggtcctcagaccacactttgagaactgctgcccaagtgtggcttcctggccatgtgaagtggcagagtcggaaatggaagtcagaggggcagctgccaggctcacaccccaccccgtcacccctcagctgcccctggacaggaagctggaactcacctctccattgaggtagatgaggtcgaaggcgtacaaacacacctgcacctggatctcagacgcatccacctcctgggttggggcacaacggagttcgtgagtgcaggaaggtgggacggggcactgtgcctgaggccgacagcattcatctaccggtctccctctcgccacctaactggctgcccatctgtgagggcggcatgctgctggctccaggtgctggatccttaacggctctcagctaattccgacaacctcattccccttcaccagatatttgctctcctagacttttctgcagctaatggcagtgacatggcacagttctggccatgagatggaaaaggggaaacctgtggggtgcaggttgtggggttttccagaacagatcttcttcatagtaaacaacagagatgccgaaa

SEQ ID NO: 287672 - DNA, 1002 bp, Homo sapiens
tgtaagatgtgcctttgctcctctttcgccttctgccatgactgtgaggcctccccagccgtgtggaactccccagttccccaggaccttgcatatggcctgcagctcctcactgtcctcgtcgtaggaggccagcaggaagcccccgtaccggccggcccgcttcccccggcccaggctcctgctcgctggccctcaacacacccgtcctccactcgaggggaaaccccaggagcttcgcacaatgacaacctgtgactcccggcacggaacccccactgacttcctgaaaccttcaagaggaagatccagttttatctcacagtggccccaggacctgaggaagatccacctcacgccaatgtggagttggaaagagagggaccttgaagatgtccttgaaagaatcttaaggaacctcaggggtcctcagaccacactttgagaactgctgcccaagtgtggcttcctggccatgtgaagtggcagagtcggaaatggaagtcagaggggcagctgccaggctcacaccccaccccgtcacccctcagctgcccctggacaggaagctggaactcacctctccattgaggtagatgaggtcgaaggcgtacaaacacacctgcacctggatctcagacgcatccacctcctgggttggggcacaacggagttcgtgagtgcaggaaggtgggacggggcactgtgcctgaggccgacagcattcatctaccggtctccctctcgccacctaactggctgcccatctgtgagggcggcatgctgctggctccaggtgctggatccttaacggctctcagctaattccgacaacctcattccccttcaccagatatttgctctcctagacttttctgcagctaatggcagtgacatggcacagttctggccatgagatggaaaaggggaaacctgtggggtgcaggttgtggggttttccagaacagatcttcttcatagtaaacaacagagatgccgaaa

SEQ ID NO: 287673 - DNA, 5455 bp, Homo sapiens
  misc_feature (488)..(488): n is a, c, g, or t
  misc_feature (534)..(534): n is a, c, g, or t
  misc_feature (576)..(576): n is a, c, g, or t
  misc_feature (621)..(621): n is a, c, g, or t
  misc_feature (643)..(643): n is a, c, g, or t
  misc_feature (942)..(942): n is a, c, g, or t
  misc_feature (1983)..(1983): n is a, c, g, or t
  misc_feature (3745)..(3745): n is a, c, g, or t
  misc_feature (3813)..(3813): n is a, c, g, or t
gcgcggagcctagacccgctgccgggccggggctgggccggagcggcggcgcctggatgccggcccggggctgggccggagactggcgcccgccccgaagcgactttcggtccccgacccgctccgcctgacccctatgatgaagagggcgtccactggagttcttgctgtcgacatctttgacaagttcaacttcacgggagccagagtcccatggttcgacgccattcatgaagaattccccagggagctggagtcctccatctccttcccagccaacttcttcaaaccacctgaagaaaaagtgcttaggtagaggttgagcatcctaatcctgaaatctgaaatgctccagaatctgaaccttcttgagcaccaacctgacacttaaaggaagtgctcattggaggatctgtgacaattactaaaaacttccccaaataaaaaggacatgaaaagaatctcacgctatcgcccaggctggagtncagtggcgcgatctccgctcactgcaagctccgcctcccgggttcncgccattctcctgcctcagcctcccgagagtagctgggactncaggcgcccgccaccacgcccagctaattttttgtatttttagtngagacggggtttcaccgtgttngccagaatggtttcgatctcctcacctcgcgatccatccgcctcagcctcccaaagtgctgggattacaggcgtgagccaccgtgcctggccctcatgtgtcttaaaaagaggggtgactctgatgtggggtcatgcttgaaactgagaggacgaggtccccgaccctccattgcagccagctctctctggaactaacagagtgagaactcgctcattaccaaggggaggacaccaagccattcatgggggacccacccccatgacccaaacaaccccgaccacgcccacctccaaccnttaagcagtccatctccagaactcttttcatcctgcagatctgaaactctagcccacaaaacaccaactccactccccagccactggtgcccaccgttgtttctgtctctgaatttgactcctctagggacctcccataagtggaatcatacaatatttgtccttttgtgcttggcttatttcactgagcgtaatgttctctaggttcacctgtgttgtagcaaacgtcagactttccctccttttgaaggctgagtaatattctgttgtgtggatggagcacgcattgtttatccactcacctgttgacgcatgcctgggtcgtttccacctttcggcctgtgtgaatggtgctgctctgaacaggggtgaagacgtatctgggcgtctgctttcagttcttttgggtgtatacccagaagtgggcttgctgggtcacgtggtaaatcctgtggttgattttttgaggacgcaccatactgttttcggtgggacatctgttgggttttgagaagcacctgctggcactgagagctgtcttggggaacacaggtgctcctgccggagtcctcacgctctgctcacgttgcagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggtaaggcctgggtatggggcacatggagagggcccattccagaggctcctaagtcaaaagagattccacaagtcaaaatcctgatcctgatcaagcacaggccttcacagtgacatttcactgtgaccctggcccagagacagagaccactgtcctgcagtgtccctgggagggaggttctgggtctgccacaggacaccacaccctggaacattgcacaccctttgcctggccttttcccagngtttctgtcagaaatgccccctcccaagcatacaccccatcttgtgccccgagggactcgattctctccccacacacccgacccgaggctgtcatgggtagtgcctgctgctggccccagggttagggctgctcagccagtcctggctggaaaggatgaatgtcccacaagcagctttggggcctgcttggtgggagcagcccgaggatccgcccttcgtcctcctgccatttcccacttccctggctctggggtcctcatgttcacgtggttctcagtgactgggtgattgacccccatgagctgtcattattttggtgtcttttgctggacatttaagccattccttgtgtttctgccattagctattatgggctgtaacatctttgcacctgtgccttctttctttttaaatttctgaagtcctaatttgacccaaaggtgacacatctccctgtgtgccctgtcagtgatgaaacctgctctggggatgaagatgccgtggggcccacagatccaagctctcggagtgtgattctgtctcccctagaaacacatccatggcatgtcctcagggcatttgtgcatgggattaagcaaatgtttcctaatcatgtttgtccctgtgctctggcttcttgacctcaggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcatgtgagggctttgccaagacacagagaacccgcagggttgttggctcagcggcagatcgtcccacggggacagtctcttgtggtctgtgtctcccccttcagccccctgtggggcagtgagcctcctgctctgcttctgtgggtgcatcagagcccccccagatgcccacacgcagacgcgcacaggcctgcacgtggaaacacagacatgcgcacacgcaggcccacacacagacgcacacagagctgcacgtggagacacgtgcgcacacgcaggcccacacgcaggcccacacacaggtgcacgcggacctgcacgtggagacacagatgtgtgcacatgcaggcccacacacaggtgagcgtggacctgtgtgaacagatgcgcgcagacctgcacgtggagacacagacatgcaggcgcacaaagagatccctcaaggctgacacccaggaaggggcctctcacttgtgggactcccgagatgcagtggccaacactagtgtagtgcccagttcactgctggataagacagaggcctgttctggtcacacatgggaggcagaacccagagactgggcccaggagcccttctgctgacagtgggaactcccagctacgtgtgggggtccccataccagacaaaggtccctgaccttagtcttgcccgagaggccgacacagcccagctttggggtctggctttacccacaagaggccacaccttgccacagcactgtttatctggcctgtttcagaagcaccgtcagagtggcgaaggcaggaggtggtgcacgagagtctacgttctagcatccattcaagtgagggaaaggcgtttcgtacttagaaaaatgcaaaattaatgattctcacccacacatgagactgtggattcacccatgtatgaganagtggattcagagccatgctgtggctctcatctgctgggagccagtagtgtttgtgctttggttttgnttttttagctacatggtttatgtgaggtgcggacttacttgagttgctctgtctttacagggagcttgctttttctctgctggtttgttttcacttttgctgtctctgtttagaagaaaacattagaactggggtgtggtggaaggatgggagcacaatctgggaggggaagacctgctctctctccacataccaggagggagtggcaggaaggggagacactgtgccggactcagggagtcaagagcgtgagcacccccaggcttcaatctgctgaacgttgtgcatctgggggcgcccgtgcagcaggaacactctccccatcacaattcctctgggcacagtggagagccatgagtgggggctgtcctgggggctgcgctatggtgagtgagcccacgccaggagccagttcagcccagcctcattcttctcctgcttctttgctttccaagttctagttcataagcaaccagcacagtacctggaatgtaagaggcgcttggcttataaaagagagaagaaaggaacccctttcaccacgagggacgtcaggcccagctctctgtcccgggcattcatcttttttccggcaattagcttcagctctaatgacctgctgtctgctttatgttgcacctatgatttccagattgtaaagtttgtggcaaatgtattaacgttcacatcccatttacagattagcaaactaaggatctgagaggttatgtgattttcccagtctggcggagggcagggccctgtcagaagccgagacacacctcgtaacagcttgttatttggggcttcccatcagtgaggcaggagtcataatggggccctggcttctgggcaattcccataaaacattgtgccacctgaagatggaagtgtcagaggaaggcgagatgttatttctgaaagcatctaccctcagaaagagacagaggagtgcatcgcagctgtgtgaacccggggtggtggtggttccagcagcggggcacgtggtggacgcaagacggccccgtttgagttttgctgctaggtgacatgtagaacttgaacttcagagggtgctccttggaggccctgatgagagagacacagaagggaagggagactgttcccatggtcctgcctctgcggcagcgagcctgctgctcttgcagctgggtggctgttcggtgcagggggccggtgaggaacacggtggggagcagcctgcgagggcgccgggctttcagcactcactatacctgctgtttggtttggccaggatggcctgggagtccccagggccgggcaaagactgcccccaacagacatgggcggagggaaccgtctcacccctgcctcttctcccttctctacgcagtgtcagtgggacgggagggtggtctgcccggggcttcaagctcctgtccaggaaccggacccatgtcgtacgccagtgcagccacacggccagcttcgaggtgctcatggacgtctccaggtgtgagatgggcatcttcttgtggccactatgcccgctgagcctacccccaaacctgcccctcctcaaactaaatcttccattctaagcactttgaacgaagcaaatcaaccaattaaaaaaatatattccaggaaaaaaaaaagt

SEQ ID NO: 287674 - DNA, 1298 bp, Homo sapiens
cagcgggtcggggaccgaaagtcgcttcggggcgggcgccagtctccggcccagccccgggccggcatccaggcgccgccgctccggcccagccccggcccggcccctatgatgaagagggcgtccactggagttcttgctgtcgacatctttgacaagttcaacttcacgggagccagagtcccatggttcgacgccattcatgaagaattccccagggagctggagtcctccatctccttcccagccaacttcttcaaaccacctgaagaaaaagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcataccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcagcgctccgcggtgcctagcacccgctcagccagggcagcctgcagcggagcttggagccagcagcttctcatctcttggcctcgggaaatgtagctggagtcatcatttagcagagcacggtgtccctgggttggccacccagcttagttttaaaataaaataatgtaatcttggcctaatggtggaa

SEQ ID NO: 287675 - DNA, 489 bp, Homo sapiens
gcggccgcacaagggcagcctaggcgagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcagcgctccgcggtgcctagcacccgctcagccagggcagcctgcagcggagcttggagccagcagcttctcatctcttggcctcgggaaatgtagctggagtcatcatttagcagagcacggtgtccctgggttggccacccagcttagttttaaaataaaataatgtaatcttggcctaatggtggaa

SEQ ID NO: 287676 - DNA, 800 bp, Homo sapiens
gcgcggagcctagacccgctgccgggccggggctgggccggagcggcggcgcctggatgccggcccggggctgggccggagactggcgcccgccccgaagcgactttcggtccccgacccgctccgcctgacccctatgatgaagagggcgtccactggagttcttgctgtcgacatctttgacaagttcaacttcacgggagccagagtcccatggttcgacgccattcatgaagaattccccagggagctggagtcctccatctccttcccagccaacttcttcaaaccacctgaagaaaaagtagagacagggtttcaccatattggccaggctggtctcgatctcctgtccttgcgatccgcccgcctccacctcccaaagtgctgggattacagaccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacaggaacaagacgaggatgcccgttctcaccacttttattagacatcacacaaatatgcaagagaaaaaaataaaagccacccacactggaaaagaggacatcaaattatccttgtctgatgaagatgtgatcttggatttacaaacatgtaaagcctccaccagaaaactctagacttgataaataaattaatacagtcatttgcaggatacaaaatcaacatacaaaaatcagcagcattttatacac

SEQ ID NO: 287677 - DNA, 3334 bp, Homo sapiens
  misc_feature (1624)..(1624): n is a, c, g, or t
  misc_feature (1692)..(1692): n is a, c, g, or t
gcgcggagcctagacccgctgccgggccggggctgggccggagcggcggcgcctggatgccggcccggggctgggccggagactggcgcccgccccgaagcgactttcggtccccgacccgctccgcctgacccctatgatgaagagggcgtccactggagttcttgctgtcgacatctttgacaagttcaacttcacgggagccagagtcccatggttcgacgccattcatgaagaattccccagggagctggagtcctccatctccttcccagccaacttcttcaaaccacctgaagaaaaagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcatgtgagggctttgccaagacacagagaacccgcagggttgttggctcagcggcagatcgtcccacggggacagtctcttgtggtctgtgtctcccccttcagccccctgtggggcagtgagcctcctgctctgcttctgtgggtgcatcagagcccccccagatgcccacacgcagacgcgcacaggcctgcacgtggaaacacagacatgcgcacacgcaggcccacacacagacgcacacagagctgcacgtggagacacgtgcgcacacgcaggcccacacgcaggcccacacacaggtgcacgcggacctgcacgtggagacacagatgtgtgcacatgcaggcccacacacaggtgagcgtggacctgtgtgaacagatgcgcgcagacctgcacgtggagacacagacatgcaggcgcacaaagagatccctcaaggctgacacccaggaaggggcctctcacttgtgggactcccgagatgcagtggccaacactagtgtagtgcccagttcactgctggataagacagaggcctgttctggtcacacatgggaggcagaacccagagactgggcccaggagcccttctgctgacagtgggaactcccagctacgtgtgggggtccccataccagacaaaggtccctgaccttagtcttgcccgagaggccgacacagcccagctttggggtctggctttacccacaagaggccacaccttgccacagcactgtttatctggcctgtttcagaagcaccgtcagagtggcgaaggcaggaggtggtgcacgagagtctacgttctagcatccattcaagtgagggaaaggcgtttcgtacttagaaaaatgcaaaattaatgattctcacccacacatgagactgtggattcacccatgtatgaganagtggattcagagccatgctgtggctctcatctgctgggagccagtagtgtttgtgctttggttttgnttttttagctacatggtttatgtgaggtgcggacttacttgagttgctctgtctttacagggagcttgctttttctctgctggtttgttttcacttttgctgtctctgtttagaagaaaacattagaactggggtgtggtggaaggatgggagcacaatctgggaggggaagacctgctctctctccacataccaggagggagtggcaggaaggggagacactgtgccggactcagggagtcaagagcgtgagcacccccaggcttcaatctgctgaacgttgtgcatctgggggcgcccgtgcagcaggaacactctccccatcacaattcctctgggcacagtggagagccatgagtgggggctgtcctgggggctgcgctatggtgagtgagcccacgccaggagccagttcagcccagcctcattcttctcctgcttctttgctttccaagttctagttcataagcaaccagcacagtacctggaatgtaagaggcgcttggcttataaaagagagaagaaaggaacccctttcaccacgagggacgtcaggcccagctctctgtcccgggcattcatcttttttccggcaattagcttcagctctaatgacctgctgtctgctttatgttgcacctatgatttccagattgtaaagtttgtggcaaatgtattaacgttcacatcccatttacagattagcaaactaaggatctgagaggttatgtgattttcccagtctggcggagggcagggccctgtcagaagccgagacacacctcgtaacagcttgttatttggggcttcccatcagtgaggcaggagtcataatggggccctggcttctgggcaattcccataaaacattgtgccacctgaagatggaagtgtcagaggaaggcgagatgttatttctgaaagcatctaccctcagaaagagacagaggagtgcatcgcagctgtgtgaacccggggtggtggtggttccagcagcggggcacgtggtggacgcaagacggccccgtttgagttttgctgctaggtgacatgtagaacttgaacttcagagggtgctccttggaggccctgatgagagagacacagaagggaagggagactgttcccatggtcctgcctctgcggcagcgagcctgctgctcttgcagctgggtggctgttcggtgcagggggccggtgaggaacacggtggggagcagcctgcgagggcgccgggctttcagcactcactatacctgctgtttggtttggccaggatggcctgggagtccccagggccgggcaaagactgcccccaacagacatgggcggagggaaccgtctcacccctgcctcttctcccttctctacgcagtgtcagtgggacgggagggtggtctgcccggggcttcaagctcctgtccaggaaccggacccatgtcgtacgccagtgcagccacacggccagcttcgaggtgctcatggacgtctccaggtgtgagatgggcatcttcttgtggccactatgcccgctgagcctacccccaaacctgcccctcctcaaactaaatcttccattctaagcactttgaacgaagcaaatcaaccaattaaaaaaatatattccaggaaaaaaaaaagt

SEQ ID NO: 287678 - DNA, 3190 bp, Homo sapiens
  misc_feature (1480)..(1480): n is a, c, g, or t
  misc_feature (1548)..(1548): n is a, c, g, or t
gcgcggagcctagacccgctgccgggccggggctgggccggagcggcggcgcctggatgccggcccggggctgggccggagactggcgcccgccccgaagcgactttcggtccccgacccgctccgcctgacccctatgatgaagagggcgtccactggagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcatgtgagggctttgccaagacacagagaacccgcagggttgttggctcagcggcagatcgtcccacggggacagtctcttgtggtctgtgtctcccccttcagccccctgtggggcagtgagcctcctgctctgcttctgtgggtgcatcagagcccccccagatgcccacacgcagacgcgcacaggcctgcacgtggaaacacagacatgcgcacacgcaggcccacacacagacgcacacagagctgcacgtggagacacgtgcgcacacgcaggcccacacgcaggcccacacacaggtgcacgcggacctgcacgtggagacacagatgtgtgcacatgcaggcccacacacaggtgagcgtggacctgtgtgaacagatgcgcgcagacctgcacgtggagacacagacatgcaggcgcacaaagagatccctcaaggctgacacccaggaaggggcctctcacttgtgggactcccgagatgcagtggccaacactagtgtagtgcccagttcactgctggataagacagaggcctgttctggtcacacatgggaggcagaacccagagactgggcccaggagcccttctgctgacagtgggaactcccagctacgtgtgggggtccccataccagacaaaggtccctgaccttagtcttgcccgagaggccgacacagcccagctttggggtctggctttacccacaagaggccacaccttgccacagcactgtttatctggcctgtttcagaagcaccgtcagagtggcgaaggcaggaggtggtgcacgagagtctacgttctagcatccattcaagtgagggaaaggcgtttcgtacttagaaaaatgcaaaattaatgattctcacccacacatgagactgtggattcacccatgtatgaganagtggattcagagccatgctgtggctctcatctgctgggagccagtagtgtttgtgctttggttttgnttttttagctacatggtttatgtgaggtgcggacttacttgagttgctctgtctttacagggagcttgctttttctctgctggtttgttttcacttttgctgtctctgtttagaagaaaacattagaactggggtgtggtggaaggatgggagcacaatctgggaggggaagacctgctctctctccacataccaggagggagtggcaggaaggggagacactgtgccggactcagggagtcaagagcgtgagcacccccaggcttcaatctgctgaacgttgtgcatctgggggcgcccgtgcagcaggaacactctccccatcacaattcctctgggcacagtggagagccatgagtgggggctgtcctgggggctgcgctatggtgagtgagcccacgccaggagccagttcagcccagcctcattcttctcctgcttctttgctttccaagttctagttcataagcaaccagcacagtacctggaatgtaagaggcgcttggcttataaaagagagaagaaaggaacccctttcaccacgagggacgtcaggcccagctctctgtcccgggcattcatcttttttccggcaattagcttcagctctaatgacctgctgtctgctttatgttgcacctatgatttccagattgtaaagtttgtggcaaatgtattaacgttcacatcccatttacagattagcaaactaaggatctgagaggttatgtgattttcccagtctggcggagggcagggccctgtcagaagccgagacacacctcgtaacagcttgttatttggggcttcccatcagtgaggcaggagtcataatggggccctggcttctgggcaattcccataaaacattgtgccacctgaagatggaagtgtcagaggaaggcgagatgttatttctgaaagcatctaccctcagaaagagacagaggagtgcatcgcagctgtgtgaacccggggtggtggtggttccagcagcggggcacgtggtggacgcaagacggccccgtttgagttttgctgctaggtgacatgtagaacttgaacttcagagggtgctccttggaggccctgatgagagagacacagaagggaagggagactgttcccatggtcctgcctctgcggcagcgagcctgctgctcttgcagctgggtggctgttcggtgcagggggccggtgaggaacacggtggggagcagcctgcgagggcgccgggctttcagcactcactatacctgctgtttggtttggccaggatggcctgggagtccccagggccgggcaaagactgcccccaacagacatgggcggagggaaccgtctcacccctgcctcttctcccttctctacgcagtgtcagtgggacgggagggtggtctgcccggggcttcaagctcctgtccaggaaccggacccatgtcgtacgccagtgcagccacacggccagcttcgaggtgctcatggacgtctccaggtgtgagatgggcatcttcttgtggccactatgcccgctgagcctacccccaaacctgcccctcctcaaactaaatcttccattctaagcactttgaacgaagcaaatcaaccaattaaaaaaatatattccaggaaaaaaaaaagt

SEQ ID NO: 287679 - DNA, 1870 bp, Homo sapiens
  misc_feature (754)..(754): n is a, c, g, or t
gcgcggagcctagacccgctgccgggccggggctgggccggagcggcggcgcctggatgccggcccggggctgggccggagactggcgcccgccccgaagcgactttcggtccccgacccgctccgcctgacccctatgatgaagagggcgtccactggagttcttgctgtcgacatctttgacaagttcaacttcacgggagccagagtcccatggttcgacgccattcatgaagaattccccagggagctggagtcctccatctccttcccagccaacttcttcaaaccacctgaagaaaaagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggtaaggcctgggtatggggcacatggagagggcccattccagaggctcctaagtcaaaagagattccacaagtcaaaatcctgatcctgatcaagcacaggccttcacagtgacatttcactgtgaccctggcccagagacagagaccactgtcctgcagtgtccctgggagggaggttctgggtctgccacaggacaccacaccctggaacattgcacaccctttgcctggccttttcccagngtttctgtcagaaatgccccctcccaagcatacaccccatcttgtgccccgagggactcgattctctccccacacacccgacccgaggctgtcatgggtagtgcctgctgctggccccagggttagggctgctcagccagtcctggctggaaaggatgaatgtcccacaagcagctttggggcctgcttggtgggagcagcccgaggatccgcccttcgtcctcctgccatttcccacttccctggctctggggtcctcatgttcacgtggttctcagtgactgggtgattgacccccatgagctgtcattattttggtgtcttttgctggacatttaagccattccttgtgtttctgccattagctattatgggctgtaacatctttgcacctgtgccttctttctttttaaatttctgaagtcctaatttgacccaaaggtgacacatctccctgtgtgccctgtcagtgatgaaacctgctctggggatgaagatgccgtggggcccacagatccaagctctcggagtgtgattctgtctcccctagaaacacatccatggcatgtcctcagggcatttgtgcatgggattaagcaaatgtttcctaatcatgtttgtccctgtgctctggcttcttgacctcaggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcattgtcagtgggacgggagggtggtctgcccggggcttcaagctcctgtccaggaaccggacccatgtcgtacgccagtgcagccacacggccagcttcgaggtgctcatggacgtctccaggtgtgagatgggcatcttcttgtggccactatgcccgctgagcctacccccaaacctgcccctcctcaaactaaatcttccattctaagcactttgaacgaagcaaatcaaccaattaaaaaaatatattccaggaaaaaaaaaagt

SEQ ID NO: 287680 - DNA, 811 bp, Homo sapiens
aggggtaacggtgactaatggtgttaaagggaaggaaagctcctgcccatctgcagcaccttcggcatctgcccctgccatgaccactgtggagaacaaatccaagattagcacaggtatgggtgacattcagtctgagacttcaactgcttttttgtttgaataggcaggatgcattggtgtttacagtgttccatctcattataggaaattgtagacatacaaaagtagatggattgatatttcagcccaatacgctcatcacgctcatcaccattatcagctcacagccagttgtaactctgtgatacccaccctcccctcttattattttgaagcagattctggacatcatatcatttcatccataaatattttattatcttggaaagagaaggattcttttaaaaatataatcctaataccattatcagtccttaaaataattgataatcattccttaaatcataccttattcaatgagtatttaaatttctaacagtcttataaatatttttgttttatttactatctatttttatgtttggatcaggactcccataggtccatatataattggctgatgtgtctcttaaatcttcttttttaaatctatgggtttaacccaattcttgcagtttaatttttgtggaagctggtcacgtgacctatagagtttctgagcatgtggatttttatatcacaatatccccatgacgtttttgcccatcaccctttgttgtgtgtatttattgtaaatggcattggagacttatgggacagattcaggtcccctgtccccccaatttga

SEQ ID NO: 287681 - DNA, 891 bp, Homo sapiens
ggttagaaatgctggatctcaatcccaacccaacctaaggaactggaatctgcattttaacaagatgccctggtgatttgtgtgtaccggagccatggaagtcaaatgctgaggatggtggcatcataggatgaatggagctgggttcttgaaacactgcctggaggaaagacagcaaaaatgcctcatgaatccaactggactgttaggatgctcacccttggagaccagcaacaatgtgtgcagaaacccaggccatgtggagaggccccacatacgtgtccaactgaggtcccagctgacagctggcattgacataatgttactctgggggaagccagctgccacgctgtaaggacactcgggcagtcctatgaagaggcccgtgtggtgagaaagagaggcctccagccaacagccatgtgagtgggccattgaggaagcagcctcagtgcctgcagccctgactggcatcctgaactaccaccttaaatgagaccctgagccagagtcactacttccaaattcttgacccacagaaattgtgaaataatatttgttgttttaagccgccaagttttgggagtaatttgttatatagcaaaagataattaatacattcacttcctaagattatggtgaagaattaaggatacagcatgaaaagaactttgctattatttttattatctgatccaatttatgttgaagggccttcagtactttcttcttttactctatcttgacatttgtctgaaacatttttgtttgtttgtttgtttgtttgtttgttttttagagatggggtcttgctatgtttcccagttggagtgcagtgattattcacagacatgatcccactactgatcagcatgggagttttcacctgct

SEQ ID NO: 287682 - DNA, 765 bp, Homo sapiens
gcggcataaatcaagtccgcggggcatggaggctgctgtcgctgcagcagctcagcttgcccggggcgggaactccccctttctcctttcgcctccccagcacccacaccctgtctcccccttaattcttccctggataatagcaccctaacgacaacagtcataataatagggttagaacgacaggggaggaaaactcaacagcctaaatatctctgaaaactgcatcgcaaaatggaagaaagagggggtcccactactgtttcaaaagagagccatggaagtcaaatgctgaggatggtggcatcataggatgaatggagctgggttcttgaaacactgcctggaggaaagacagcaaaaatgcctcatgaatccaactggactgttaggatgctcacccttggagaccagcaacaatgtgtgcagaaacccaggccatgtggagaggccccacatacgtgtccaactgaggtcccagctgacagctggcattgacataaaacagagcttcctgaaaaacaactattgaaggaatatgagtcactgtcaaaattgtgagtcatccatttcttcttgccagtgcagcacactcccaggggacacgtggcttcactcctgaacaagttcagtaagcagtgctggagagaatactgaaaacgttaaagaattatgaatacagctcagatctcactttcctgttttttagattttgggaattcattcaggtggaaacagcatttcttgccatcacatgatgggggt

SEQ ID NO: 287683 - DNA, 646 bp, Homo sapiens
gcggcataaatcaagtccgcggggcatggaggctgctgtcgctgcagcagctcagcttgcccggggcgggaactccccctttctcctttcgcctccccagcacccacaccctgtctcccccttaattcttccctggataatagcaccctaacgacaacagtcataataatagggttagaacgacaggggaggaaaactcaacagcctaaatatctctgaaaactgcatcgcaaaatggaagaaagagggggtcccactactgtttcaaaagagagccatggaagtcaaatgctgaggatggtggcatcataggatgaatggagctgggttcttgaaacactgcctggaggaaagacagcaaaaatgcctcatgaatccaactggactgttaggatgctcacccttggagaccagcaacaatgtgtgcagaaacccaggccatgtggagaggccccacatacgtgtccaactgaggtcccagctgacagctggcattgacatgtgagtgagactctgaacgttccagctgatgacaagtacagtttgagcgagctatccctgttgggcctgtcaaaactgcagatttcatgaagaaaataagtgttgttgacttaagccagtaagttttgacatactatgttacaca

SEQ ID NO: 287684 - DNA, 1649 bp, Homo sapiens
  misc_feature (1)..(4): n is a, c, g, or t
  misc_feature (374)..(374): n is a, c, g, or t
  misc_feature (1402)..(1405): n is a, c, g, or t
nnnnaaactcctgaccttgtgatccacccaatcttcattgcatcatttaactttcattggtatcacagtaattcactaacattcattccttacaggcagttatgaataattgaaaaatttttaacatcatctcatgggcaaaagaatatttattcattggcttagcttaacaaatcattattaaacacctattgtgtgccaggcactgttctagacactggagttacagcagtgaacaaaataaacacgctctccagtctggtgggagttcacatactggtgcggggagagagatgcatacaaacaaaaatgcatatttaatacttcaccaactgataggtgctatgaagaaaaataaaccatagtaaggatgncatagagtgctggatggaggttttagtacatatacgttagccagagaaggcatctctgagaagttgccatttgagaaaaagagggagtaggctcagtggattctgagggaagaataagtttgagattctgagtcattcatgtccttggcagatcaataaagaggaagcagatgctgtggccggaactcagtgtgcatgttggggcagtggtaggaggctatggttgtaagacagggctacctcccatagggtcttgaagaccatagtaaagactgtggcatctcctctccagtagtttgagcagaggaatggtagcattctacttaggatttaaaaggtttgctctagctgatttgtggagaataggtttgtaaggcagcatagtgaatgaaaggagaaaagttaggcgattgcaaacatccaggtgagagttgatatcagacggtgatggtgtcacagatgcgtttcatgcgatgggctcaattaatggcctccatgtttcacccttctctttcttgggactggcttgcctgctggaaggtgaggaaacagcctgtcatcccagctgaggccatcctagatcagccaactgtcagctgcttgtgtgtcagtgaaccccagccaagaccagaagacctgcccagctgagctcagccaagatcagcaaaacctctcagcttataaccttataaacttaccaatttaggtgtggttgtgacacagaattattgtattattgtatgcatggtgagtattgtatattacacatgggaatcatagaaacagtgaaaagccagtaatttctgagtatatattaaagttagggcaaattgtgtgaggtggagaagccacatactccaaatttctggcctgagacattggaagaatgaatatggatgatggaggtggatattgaatctgaaatgaatttttcattttgtgaaattttgtgaagtttcattttgtgttgaatatcttgtgactcaccgaaatgaaaatcataaaataaaatttgtccttaatgcatnnnnaaaaaaagcacatgaagggggccgacgtctagcgagcaacgggataacaggtcgcgtccttcgttgtcgtcctcgtctatttcattctgtcttgctgcgttggcgtccgtgtctgtggtcgtcgtttcttttgccgtcttgtgtgtttcacgtcgcttggctgagaccagctattcgtctccgcgctgcttactcgctccggcgatataccaacgccaggcgccctctgagcagaatcgataca

SEQ ID NO: 287685 - DNA, 1293 bp, Homo sapiens
  misc_feature (1046)..(1049): n is a, c, g, or t
ggttagaaatgctggatctcaatcccaacccaacctaaggaactggaatctgcattttaacaagatgccctggtgatttgtgtgtaccgagtttgggacaccacttgaggccaagacctctgagtgtaacaacagactgagagaattcctgattggggatctggaaactccaggagattggacctgcaccagagagaaaatttggaagagatggaggcagatgtggagccatggaagtcaaatgctgaggatggtggcatcataggatgaatggagctgggttcttgaaacactgcctggaggaaagacagcaaaaatgcctcatgaatccaactggactgttaggatgctcacccttggagaccagcaacaatgtgtgcagaaacccaggccatgtggagaggccccacatacgtgtccaactgaggtcccagctgacagctggcattgacataatgttactctgggggaagccagctgccacgctgtaaggacactcgggcagtcctatgaagaggcccgtgtggtgagaaagagaggcctccagccaacagccatgtgaggaaacagcctgtcatcccagctgaggccatcctagatcagccaactgtcagctgcttgtgtgtcagtgaaccccagccaagaccagaagacctgcccagctgagctcagccaagatcagcaaaacctctcagcttataaccttataaacttaccaatttaggtgtggttgtgacacagaattattgtattattgtatgcatggtgagtattgtatattacacatgggaatcatagaaacagtgaaaagccagtaatttctgagtatatattaaagttagggcaaattgtgtgaggtggagaagccacatactccaaatttctggcctgagacattggaagaatgaatatggatgatggaggtggatattgaatctgaaatgaatttttcattttgtgaaattttgtgaagtttcattttgtgttgaatatcttgtgactcaccgaaatgaaaatcataaaataaaatttgtccttaatgcatnnnnaaaaaaagcacatgaagggggccgacgtctagcgagcaacgggataacaggtcgcgtccttcgttgtcgtcctcgtctatttcattctgtcttgctgcgttggcgtccgtgtctgtggtcgtcgtttcttttgccgtcttgtgtgtttcacgtcgcttggctgagaccagctattcgtctccgcgctgcttactcgctccggcgatataccaacgccaggcgccctctgagcagaatcgataca

SEQ ID NO: 287686 - DNA, 401 bp, Homo sapiens
catagaaacagtgaaaagccagtaatttctgagtatatattaaagttagggcaaattgtgtgaggtggagaagccacatactccaaatttctggcctgagacattggaagaatgaatatggatgatggaggtggatattgaatctgaaatgaatttttcattttgtgaaattttgtgaagtttcattttgtgttgaatatcttgtgactcaccgaaatgaaaatcataaaataaaatttgtccttaatgcctaaaattttataatgttgttctattctttaggaaaaaaaattctggctgggcgtggtggctcacgtctgtaatcccaacagtttgggaggccattgaggtcaggagttcacgaccagcatggccaacatggtgaaaccccatctcttaaa

SEQ ID NO: 287687 - DNA, 331 bp, Homo sapiens
atctctgagaagttgccatttgagaaaaagagggagtaggctcagtggattctgagggaagaataagtttgagattctgagtcattcatgtccttggcagatcaataaagaggaagcagatgctgtggccggaactcagtgtgcatgttggggcagtggtaggaggctatggttgtaagacagggctacctcccatagggtcttgaagaccatagtaaagactgtggcatctcctctccagtagtttgagcagaggaatggtagcattctacttaggatttaaaaggtttgctctagctgatttgtggagaataggtttgtaaggcagcat

SEQ ID NO: 287688 - DNA, 641 bp, Homo sapiens
tttttttttcttcaattctatgtttaatatccatctacctggaaacttcacattccaggcctgccttccgggaacaacagggcgagggtggaaaaagagggttgcctccaggagaagcacgttttcctggggttggaactggggagaagcagggccggcacgaggagggaggtggtgggcgatggcgccttcggacaggggtggggtctgcaggatcccaggaccaggcagaggacgcggccttcccgggagtggggctgcagcgctgccctccaggcgccgatgaggagcccagggcgagagtccaactcgctggtgaggacctgaaacagcgcgaggcgggaggacgggtcgggaagggttttgagaaggaaagtttcgctacaggaggtgtctgcacggccctactgcagaaaagaccgggacgggaccagcctcagggcgactttaaactcaaaaggaaaagactcacggactcccacccggacgtctcaatttgctctgagttgagaaagaggggccggaatttccagcatcacgtctctgtatagagtcctctgagcagggtccaggcatttccactcctcctgagagaattctatggccacatccctgaatgtcagtagaccctgaaaggaaaa

SEQ ID NO: 287689 - DNA, 1544 bp, Homo sapiens
agcggggggcccggcccgttaagaagagcgtggccggccgcggccaccgctggccccagggaaagccgagcggccaccgagccggcagagacccaccgagcggcggcggagggagcagcgccggggcgcacgagggcaccatggcccagacgcccgccttcgacaagcccaaagtagaactgcatgtccacctagacggatccatcaagcctgaaaccatcttatactatggcaggaggagagggatcgccctcccagctaacacagcagaggggctgctgaacgtcattggcatggacaagccgctcacccttccagacttcctggccaagtttgactactacatgcctgctatcgcgggctgccgggaggctatcaaaaggatcgcctatgagtttgtagagatgaaggccaaagagggcgtggtgtatgtggaggtgcggtacagtccgcacctgctggccaactccaaagtggagccaatcccctggaaccaggctgaaggggacctcaccccagacgaggtggtggccctagtgggccagggcctgcaggagggggagcgagacttcggggtcaaggcccggtccatcctgtgctgcatgcgccaccagcccaactggtcccccaaggtggtggagctgtgtaagaagtaccagcagcagaccgtggtagccattgacctggctggagatgagaccatcccaggaagcagcctcttgcctggacatgtccaggcctaccaggaggctgtgaagagcggcattcaccgtactgtccacgccggggaggtgggctcggccgaagtagtaaaagaggctgtggacatactcaagacagagcggctgggacacggctaccacaccctggaagaccaggccctttataacaggctgcggcaggaaaacatgcacttcgagatctgcccctggtccagctacctcactggtgcctggaagccggacacggagcatgcagtcattcggctcaaaaatgaccaggctaactactcgctcaacacagatgacccgctcatcttcaagtccaccctggacactgattaccagatgaccaaacgggacatgggctttactgaagaggagtttaaaaggctgaacatcaatgcggccaaatctagtttcctcccagaagatgaaaagagggagcttctcgacctgctctataaagcctatgggatgccaccttcagcctctgcagggcagaacctctgaagacgccactcctccaagccttcaccctgtggagtcaccccaactctgtggggctgagcaacatttttacatttattccttccaagaagaccatgatctcaatagtcagttactgatgctcctgaaccctatgtgtccatttctgcacacacgtatacctcggcatggccgcgtcacttctctgattatgtgccctggccagggaccagcgcccttgcacatgggcatggttgaatctgaaaccctccttctgtggcaacttgtactgaaaatctggtgctcaataaagaagcccatggctggtggcatgca

SEQ ID NO: 287690 - DNA, 950 bp, Homo sapiens
  misc_feature (862)..(862): n is a, c, g, or t
agcggggggcccggcccgttaagaagagcgtggccggccgcggccaccgctggccccagggaaagccgagcggccaccgagccggcagagacccaccgagcggcggcggagggagcagcgccggggcgcacgagggcaccatggcccagacgcccgccttcgacaagcccaaagtagaactgcatgtccacctagacggatccatcaagcctgaaaccatcttatactatggcaggaggagagggatcgccctcccagctaacacagcagaggggctgctgaacgtcattggcatggacaagccgctcacccttccagacttcctggccaagtttgactactacatgcctgctatcgcgggctgccgggaggctatcaaaaggatcgcctatgagtttgtagagatgaaggccaaagagggcgtggtgtatgtggaggtgcggtacagtccgcacctgctggccaactccaaagtggagccaatcccctggaaccaggctgaaggggacctcaccccagacgaggtggtggccctagtgggccagggcctgcaggagggggagcgagacttcggggtcaaggcccggtccatcctgtgctgcatgcgccaccagcccaactggtcccccaaggtggtggagctgtgtaagaagtaccagcagcagaccgtggtagccattgacctggctggagatgagaccatcccaggaagcagcctcttgcctggacatgtccaggcctaccaggctgtggacatactcaagacagagcggctgggacacggctaccacaccctggaagaccaggccctttataacaggctgcggcaggaaaacatgcacttcgagatctgccctggtcnagtactcaatggtgcctgaaagcacggaacagacacatcaacacacacgctcacaactacaaggcatgatatcagcaaacaagaatag

SEQ ID NO: 287691 - DNA, 2012 bp, Homo sapiens
agcggggggcccggcccgttaagaagagcgtggccggccgcggccaccgctggccccagggaaagccgagcggccaccgagccggcagagacccaccgagcggcggcggagggagcagcgccggggcgcacgagggcaccatggcccagacgcccgccttcgacaagcccaaagtagaactgcatgtccacctagacggatccatcaagcctgaaaccatcttatactatggcaggaggagagggatcgccctcccagctaacacagcagaggggctgctgaacgtcattggcatggacaagccgctcacccttccagacttcctggccaagtttgactactacatgcctgctatcgcgggctgccgggaggctatcaaaaggatcgcctatgagtttgtagagatgaaggccaaagagggcgtggtgtatgtggaggtgcggtacagtccgcacctgctggccaactccaaagtggagccaatcccctggaaccaggctgaaggggacctcaccccagacgaggtggtggccctagtgggccagggcctgcaggagggggagcgagacttcggggtcaaggcccggtccatcctgtgctgcatgcgccaccagcccaactggtcccccaaggtggtggagctgtgtaagaagtaccagcagcagaccgtggtagccattgacctggctggagatgagaccatcccaggaagcagcctcttgcctggacatgtccaggcctaccaggaggctgtgaagagcggcattcaccgtactgtccacgccggggaggtgggctcggccgaagtagtaaaagaggctgtggacatactcaagacagagcggctgggacacggctaccacaccctggaagaccaggccctttataacaggctgcggcaggaaaacatgcacttcgagatctgcccctggtccagctacctcactggtgcctggaagccggacacggagcatgcagtcattcggctcaaaaatgaccaggctaactactcgctcaacacagatgacccgctcatcttcaagtccaccctggacactgattaccagatgaccaaacgggacatgggctttactgaagaggagtttaaaaggctgaacatcaatgcggccaaatctagtttcctcccagaagatgaaaagagggagcttctcgacctgctctataaagcctatgggatgccaccttcagcctctgcagggcagaacctctgaagacgccactcctccaagccttcaccctgtggagtcaccccaactctgtggggctgagcaacatttttacatttattccttccaagaagaccatgatctcaatagtcagttactgatgctcctgaaccctatgtgtccatttctgcacacacgtatacctcggcatggccgcgtcacttctctgattatgtgccctggccagggaccagcgcccttgcacatgggcatggttgaatctgaaaccctccttctgtggcaacttgtactgaaaatctggtgctcaataaagaagcccatggctggtggcatgcaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaggggggggggcaccaaagaaaacccccaggggggcccaaaaacaaggacaagagaggtttggtaaaaagaggggcgcataatagagagcgataaaaatagaagagaagtagacgggagagtaaacaacaaggtggaggggagaaaacgtggtggagaagtatttaaagacgaagcaccacaaccagaggggcggggagacaaacaacacgggcgcgcaaaccccccaccacagagcagaaagagacgacgaagagagacacacagcaacgcacgagcggaggtataaggcgaacacacccacgcagaatataacgcggcggcgagacaagaccgacgccccgcggagccgatacacaccgaaaaataatacag

SEQ ID NO: 287692 - DNA, 1595 bp, Homo sapiens
agcggggggcccggcccgttaagaagagcgtggccggccgcggccaccgctggccccagggaaagccgagcggccaccgagccggcagagacccaccgagcggcggcggagggagcagcgccggggcgcacgagggcaccatggcccagacgcccgccttcgacaagcccaaagtagaactgcatgtccacctagacggatccatcaagcctgaaaccatcttatactatggcaggaggagagggatcgccctcccagctaacacagcagaggggctgctgaacgtcattggcatggacaagccgctcacccttccagacttcctggccaagtttgactactacatgcctgctatcgcgggctgccgggaggctatcaaaaggatcgcctatgagtttgtagagatgaaggccaaagagggcgtggtgtatgtggaggtgcggtacagtccgcacctgctggccaactccaaagtggagccaatcccctggaaccaggctgaaggggacctcaccccagacgaggtggtggccctagtgggccagggcctgcaggagggggagcgagacttcggggtcaaggcccggtccatcctgtgctgcatgcgccaccagcccaactggtcccccaaggtggtggagctgtgtaagaagtaccagcagcagaccgtggtagccattgacctggctggagatgagaccatcccaggaagcagcctcttgcctggacatgtccaggcctaccaggaggctgtgaagagcggcattcaccgtactgtccacgccggggaggtgggctcggccgaagtagtaaaagaggctgtggacatactcaagacagagcggctgggacacggctaccacaccctggaagaccaggccctttataacaggctgcggcaggaaaacatgcacttcgagatctgcccctggtccagctacctcactggtgcctggaagccggacacggagcatgcagtcattcggctcaaaaatgaccaggctaactactcgctcaacacagatgacccgctcatcttcaagtccaccctggacactgattaccagatgaccaaacgggacatgggctttactgaagaggagtttaaaaggctgaacatcaatgcggccaaatctagtttcctcccagaagatgaaaagagggagcttctcgacctgctctataaagcctatgggatgccaccttcagcctctgcagggcagaacctctgaagacgccactcctccaagccttcaccctgtggagtcaccccaactctgtggggctgagcaacatttttacatttattccttccaagaagaccatgatctcaatagtcagttactgatgctcctgaaccctatgtgtccatttctgcacacacgtatacctcggcatggccgcgtcacttctctgattatgtgccctggccagggaccagcgcccttgcacatgggcatggttgaatctgaaaccctccttctgtggcaacttgtactgaaaatctggtgctcaataaagaagcccatggctggtggcatgcaaacaaaaatacctttcaaaaacataatcttcctcggcctccttggcctcaa

SEQ ID NO: 287693 - DNA, 1620 bp, Homo sapiens
agcggggggcccggcccgttaagaagagcgtggccggccgcggccaccgctggccccagggaaagccgagcggccaccgagccggcagagacccaccgagcggcggcggagggagcagcgccggggcgcacgagggcaccatggcccagacgcccgccttcgacaagcccaaagtagaactgcatgtccacctagacggatccatcaagcctgaaaccatcttatactatggcaggaggagagggatcgccctcccagctaacacagcagaggggctgctgaacgtcattggcatggacaagccgctcacccttccagacttcctggccaagtttgactactacatgcctgctatcgcgggctgccgggaggctatcaaaaggatcgcctatgagtttgtagagatgaaggccaaagagggcgtggtgtatgtggaggtgcggtacagtccgcacctgctggccaactccaaagtggagccaatcccctggaaccaggctgaaggggacctcaccccagacgaggtggtggccctagtgggccagggcctgcaggagggggagcgagacttcggggtcaaggcccggtccatcctgtgctgcatgcgccaccagcccaactggtcccccaaggtggtggagctgtgtaagaagtaccagcagcagaccgtggtagccattgacctggctggagatgagaccatcccaggaagcagcctcttgcctggacatgtccaggcctaccaggaggctgtgaagagcggcattcaccgtactgtccacgccggggaggtgggctcggccgaagtagtaaaagaggtgagggcctgggctggccatggggtccctcctcactgcctcctcccatacttggctctattctgcttctctacaggctgtggacatactcaagacagagcggctgggacacggctaccacaccctggaagaccaggccctttataacaggctgcggcaggaaaacatgcacttcgagatctgcccctggtccagctacctcactggtgcctggaagccggacacggagcatgcagtcattcggctcaaaaatgaccaggctaactactcgctcaacacagatgacccgctcatcttcaagtccaccctggacactgattaccagatgaccaaacgggacatgggctttactgaagaggagtttaaaaggctgaacatcaatgcggccaaatctagtttcctcccagaagatgaaaagagggagcttctcgacctgctctataaagcctatgggatgccaccttcagcctctgcagggcagaacctctgaagacgccactcctccaagccttcaccctgtggagtcaccccaactctgtggggctgagcaacatttttacatttattccttccaagaagaccatgatctcaatagtcagttactgatgctcctgaaccctatgtgtccatttctgcacacacgtatacctcggcatggccgcgtcacttctctgattatgtgccctggccagggaccagcgcccttgcacatgggcatggttgaatctgaaaccctccttctgtggcaacttgtactgaaaatctggtgctcaataaagaagcccatggctggtggcatgca

SEQ ID NO: 287694 - DNA, 899 bp, Homo sapiens
catgacctggctctcccccttccaggaggctgtgaagagcggcattcaccgtactgtccacgccggggaggtgggctcggccgaagtagtaaaagaggtgagggcctgggctggccatggggtccctcctcactgcctcctcccatacttggctctattctgcttctctacaggctgtggacatactcaagacagagcggctgggacacggctaccacaccctggaagaccaggccctttataacaggctgcggcaggaaaacatgcacttcgagatctgcccctggtccagctacctcactggtgcctggaagccggacacggagcatgcagtcattcggctcaaaaatgaccaggctaactactcgctcaacacagatgacccgctcatcttcaagtccaccctggacactgattaccagatgaccaaacgggacatgggctttactgaagaggagtttaaaaggctgaacatcaatgcggccaaatctagtttcctcccagaagatgaaaagagggagcttctcgacctgctctataaagcctatgggatgccaccttcagcctctgcagggcagaacctctgaagacgccactcctccaagccttcaccctgtggagtcaccccaactctgtggggctgagcaacatttttacatttattccttccaagaagaccatgatctcaatagtcagttactgatgctcctgaaccctatgtgtccatttctgcacacacgtatacctcggcatggccgcgtcacttctctgattatgtgccctggccagggaccagcgcccttgcacatgggcatggttgaatctgaaaccctccttctgtggcaacttgtactgaaaatctggtgctcaataaagaagcccatggctggtggcatgca

SEQ ID NO: 287695 - DNA, 1183 bp, Homo sapiens
agcggggggcccggcccgttaagaagagcgtggccggccgcggccaccgctggccccagggaaagccgagcggccaccgagccggcagagacccaccgagcggcggcggagggagcagcgccggggcgcacgagggcaccatggcccagacgcccgccttcgacaagcccaaagtagaactgcatgtccacctagacggatccatcaagcctgaaaccatcttatactatggcaggaggagagggatcgccctcccagctaacacagcagaggggctgctgaacgtcattggcatggacaagccgctcacccttccagacttcctggccaagtttgactactacatgcctgctatcgcgggctgccgggaggctatcaaaaggatcgcctatgagtttgtagagatgaaggccaaagagggcgtggtgtatgtggaggtgcggtacagtccgcacctgctggccaactccaaagtggagccaatcccctggaaccaggctgaaggggacctcaccccagacgaggtggtggccctagtgggccagggcctgcaggagggggagcgagacttcggggtcaaggcccggtccatcctgtgctgcatgcgccaccagcccaactggtcccccaaggtggtggagctgtgtaagaagtaccagcagcagaccgtggtagccattgacctggctggagatgagaccatcccaggaagcagcctcttgcctggacatgtccaggcctaccaggtgggtcctgtgagaaggaatggagaggctggccctgggtgagcttgtctcccacccatagttgggagaaatcacaagaaccagggaccatggtgtctcctgagttctgaagtgtgtctttgttgggtcttaaggcttggaactggaatccccctgggccaggcgtggtggttcatgcctgtgatcccagcactttgggaggcgaggcaggaggattgcttgagcctaggagtttgagaccagccagggcaacatagtgagatccatctctgcaaatacaaaaaaaagtagtcaggcatggtggtgcatgcctgtagtcccagctacttgggaggctgaggtgggagaattgcttgagtccaggaagtcaaagctgcagtgagctgtgataatgcgactgcactccagcctgggtgacagagggagaccctgtctca

SEQ ID NO: 287696 - DNA, 186 bp, Homo sapiens
ctgattaccagatgaccaaacgggacatgggctttactgaagaggagtttaaaaggctggtgagtgggtgtgagccatactggccttgactcgggtttgggagtatggtatctacaggtccagtccggggcctggaatctttggagagagggagtgagtctgcctcaacagtccaagacaagccca

SEQ ID NO: 287697 - DNA, 802 bp, Homo sapiens
aacatcaatgcggccaaatctagtttcctcccagaagatgaaaagagggagcttctcgacctgctctataaagcctatgggatgccaccttcagcctctgcaggtaggttcctgtctgggcttctgggcagttgccctgtcctggccccagtgtggctttctgtgggacttctagcaagatgcccttccattcttgggcagcgccatgaatgtgtgatgactccctggtttctgggccctggctgggagcagcgtctcattagatcggtttgttttctataaaagttcttgagaggctgttctaaggggagactttctgaagcccagtcccaaaggtctgggcagttggggacacctccatggctgcccaaagccaagggcagggagaggggcccaggcctgttctgctcctttcttcctatgtggtcttggcaaggcatcttcttgccatcataggaaggagttcctttctggttctggtgttctatgatttttacaacatcctgggtactacaagttgcctgatctttttgcttctctgaaccaacgagcagggcagaacctctgaagacgccactcctccaagccttcaccctgtggagtcaccccaactctgtggggctgagcaacatttttacatttattccttccaagaagaccatgatctcaatagtcagttactgatgctcctgaaccctatgtgtccatttctgcacacacgtatacctcggcatggccgcgtcacttctctgattatgtgccctggccagggaccagcgcccttgcacatgggcatggttga

SEQ ID NO: 287698 - DNA, 1686 bp, Homo sapiens
  misc_feature (1686)..(1686): n is a, c, g, or t
gccccggcgcgtctaggtcccccaggtctctccgggcctccggctccgtatagccgcgcatcctagcccgaagctgatgctgcccggtcggctccggccttcccggctgcctgacccgccgggccccaagccccgggctccggcctgggcccagcggcctggagcgcggccttggcccgtctgcccgccgcctcgccgccacgacttcgcccgtctgtgccccaccggccgcacctttgaataggtagtcgtactcgtcgtcccgggtccccattgtcctggcgcttccggcgggatcggcgactccgcagccccaccacaaacacccgacgggggcggagccggcgccgcgcagagcggcggttgaatggcctatcagcggcgagtggagtagcgacgggcacccagcgaagccaatcagagatggaagtagtgctctgagggtgggcgccgcttggtaccaccctcctcgccctcggtgtcctggagaaaggcggaaggaatgcggacctttttgaagtgacggacgcgccagcctatcaggggcgagctcaagagggcggggcggaagactgcaggaatgaaatggattgacagaccaaataactaatgagaggcttgattgagaacctacccgactatcagaggacctgtccgggaagagaaatggggctacgtccagacagaatctcgctctgttgcctgggctggagtgcagtggcactgtatccggaattggggggttcttggtctcactgacttcaagaatgaagccacggacccttgcgagatgggggttccaccatgttggcccggctggtctcgaactgctgacctcaagtgacctgcctgtctcggcctcacaaatggctgggattacaggcacgagacaccgtgcctggccctgggaacatgtttacatggactttgttcactttttaaaacaaactgagggtaacttactagatctgtgaactaaagaaagagaaaaaaaagaaagaaaacaaacaagaacaaaaaaaaaaaaaaaaaaaaaaaaaaaaaaaaaaaaaaaaaaaaaagaaacaaaaaaaaagggggggcgggcgggccgcctaagaagaattcccccccggggggggcgccacacgataactcgcgcgacgaccaccgacggtaattggtgagacaaagaggggcgcgccacaataaaggagagagcgcgcgtataataaaaacctaccgagcgacgagcgaggcgcgcgcgagagttaaacaacacggtagggagcaggagaggggaaacaacacgatccggcgcggtcctgcgcgaggaggaacaccactgtgtggagagacacgagcagacaccacctaacctccactggcgaggggggggagcgagacaacaaaatatggggggggcaacacacaatctactcgctagcttagcagaaaagtattttatatagcgccccccctaggcggggcgggaatcaaatataacaacaaactctctcaaacacgcggggttaattaatggcggtgggtcatagccaccaccagaagccggacataatttaacgactcgtcgcgccgtagaagaacagaatctcgcgcgtacattctgagggcagtttagtgctatctaccaaaagccagcatttattttacacgacggcgtatgctggataatataaaagtgtn

SEQ ID NO: 287699 - DNA, 1743 bp, Homo sapiens
  misc_feature (1743)..(1743): n is a, c, g, or t
gccccggcgcgtctaggtcccccaggtctctccgggcctccggctccgtatagccgcgcatcctagcccgaagctgatgctgcccggtcggctccggccttcccggctgcctgacccgccgggccccaagccccgggctccggcctgggcccagcggcctggagcgcggccttggcccgtctgcccgccgcctcgccgccacgacttcgcccgtctgtgccccaccggccgcacctttgaataggtagtcgtactcgtcgtcccgggtccccattgtcctggcgcttccggcgggatcggcgactccgcagccccaccacaaacacccgacgggggcggagccggcgccgcgcagagcggcggttgaatggcctatcagcggcgagtggagtagcgacgggcacccagcgaagccaatcagagatggaagtagtgctctgagggtgggcgccgcttggtaccaccctcctcgccctcggtgtcctggagaaaggcggaaggaatgcggacctttttgaagtgacggacgcgccagcctatcaggggcgagctcaagagggcggggcggaagactgcaggaatgaaatggattgacagaccaaataactaatgagaggcttgattgagaacctacccgactatcagaggacctgtccgggaagagaaatggggctacgtccagacagaatctcgctctgttgcctgggctggagtgcagtggcactgtatccggaattggggggttcttggtctcactgacttcaagaatgaagccacggacccttgcggtaagtgttccagctcttaaggtggcgcgtctggagtttgtttcttctgatgttcagagatgggggttccaccatgttggcccggctggtctcgaactgctgacctcaagtgacctgcctgtctcggcctcacaaatggctgggattacaggcacgagacaccgtgcctggccctgggaacatgtttacatggactttgttcactttttaaaacaaactgagggtaacttactagatctgtgaactaaagaaagagaaaaaaaagaaagaaaacaaacaagaacaaaaaaaaaaaaaaaaaaaaaaaaaaaaaaaaaaaaaaaaaaaaaagaaacaaaaaaaaagggggggcgggcgggccgcctaagaagaattcccccccggggggggcgccacacgataactcgcgcgacgaccaccgacggtaattggtgagacaaagaggggcgcgccacaataaaggagagagcgcgcgtataataaaaacctaccgagcgacgagcgaggcgcgcgcgagagttaaacaacacggtagggagcaggagaggggaaacaacacgatccggcgcggtcctgcgcgaggaggaacaccactgtgtggagagacacgagcagacaccacctaacctccactggcgaggggggggagcgagacaacaaaatatggggggggcaacacacaatctactcgctagcttagcagaaaagtattttatatagcgccccccctaggcggggcgggaatcaaatataacaacaaactctctcaaacacgcggggttaattaatggcggtgggtcatagccaccaccagaagccggacataatttaacgactcgtcgcgccgtagaagaacagaatctcgcgcgtacattctgagggcagtttagtgctatctaccaaaagccagcatttattttacacgacggcgtatgctggataatataaaagtgtn

SEQ ID NO: 287700 - DNA, 1084 bp, Homo sapiens
  misc_feature (1084)..(1084): n is a, c, g, or t
ctgcagactggactcaccaccagctccagtgacagtgggctcagaggagatcctctaagcctgctcagtacaggacacagacagaatctcgctctgttgcctgggctggagtgcagtggcactgtatccggaattggggggttcttggtctcactgacttcaagaatgaagccacggacccttgcgagatgggggttccaccatgttggcccggctggtctcgaactgctgacctcaagtgacctgcctgtctcggcctcacaaatggctgggattacaggcacgagacaccgtgcctggccctgggaacatgtttacatggactttgttcactttttaaaacaaactgagggtaacttactagatctgtgaactaaagaaagagaaaaaaaagaaagaaaacaaacaagaacaaaaaaaaaaaaaaaaaaaaaaaaaaaaaaaaaaaaaaaaaaaaaagaaacaaaaaaaaagggggggcgggcgggccgcctaagaagaattcccccccggggggggcgccacacgataactcgcgcgacgaccaccgacggtaattggtgagacaaagaggggcgcgccacaataaaggagagagcgcgcgtataataaaaacctaccgagcgacgagcgaggcgcgcgcgagagttaaacaacacggtagggagcaggagaggggaaacaacacgatccggcgcggtcctgcgcgaggaggaacaccactgtgtggagagacacgagcagacaccacctaacctccactggcgaggggggggagcgagacaacaaaatatggggggggcaacacacaatctactcgctagcttagcagaaaagtattttatatagcgccccccctaggcggggcgggaatcaaatataacaacaaactctctcaaacacgcggggttaattaatggcggtgggtcatagccaccaccagaagccggacataatttaacgactcgtcgcgccgtagaagaacagaatctcgcgcgtacattctgagggcagtttagtgctatctaccaaaagccagcatttattttacacgacggcgtatgctggataatataaaagtgtn

SEQ ID NO: 287701 - DNA, 627 bp, Homo sapiens
tatctttgtcttcataagggctgctaggctgtttcgtagcagtctccgggctactaggccgttgtgtgctggtagtacctggttcactgaaaggcgcatctccctccccgcgtcgccctgaagcaggggaaggacttcgcccagccaaggcagttgtatgagttttagctgcagcacttcgagacctgcaggagttaattgaggacgtgggagaggaaggaaatcagctcaaagggagaacagaaaaccccctccccaactcccatccacctttcctaactggacaaccctcttccaaaaagcctttagtcgcacaactcaaatcattcactgaaatgcaagtacagtccactttggttcttcttttcccaacacaatcccaaagagcgttctccctctacccctttactcacctcccccaaacatccccaaaccatccacccagcccactccctacccgcttcattcacaactcacctctgagcccacctccttcaggaagccttccccgattaaggaagccagggtaaggattccttcctcccccagacaccacgaacaaaccaccaccccccctattctggcagtccatatacatcagaacgaaacaaaaataacaaataaaca

SEQ ID NO: 287702 - DNA, 316 bp, Homo sapiens
ccccggggcccgcgcccccgcggcagggatgcatcatggccacgctggcttgccgggtgcagttcttggacgacacggaccctttcaacagcaccaacttccccgagcccagccggccgccgctgttcacgttccgcgaggacctcgcgctcggcacccagctggcgggggtccataggctgctgcaggcgccgcacaagctggatgactgtactctgcagctctctcacaatggcgcctacctggatttggaggccaccctggcagagcagcgggatgagttggaaggcttccaggatgacgccgggtaagagca

SEQ ID NO: 287703 - DNA, 2782 bp, Homo sapiens
  misc_feature (820)..(820): n is a, c, g, or t
  misc_feature (1379)..(1379): n is a, c, g, or t
  misc_feature (1388)..(1388): n is a, c, g, or t
  misc_feature (1399)..(1399): n is a, c, g, or t
  misc_feature (1440)..(1441): n is a, c, g, or t
  misc_feature (1620)..(1621): n is a, c, g, or t
  misc_feature (2550)..(2550): n is a, c, g, or t
agtactagcttcagaaggaaaagctttattttctcagagaaaagggtggtagattaaggaaatgacccagcatgttggtattttgttgttgttgttgtttaggtgtacatttaaatgcttatcaaaaaggaaacattgtcatgtcaaagaccactgcaggggaagcccagaggtggctgtaagcaagcagatcacaagtcctttaacaagttctttcaaatagcagtagagctcagaggggggctgttgtttcaaacaagattcaattagcatcaagttattaaagggcagccggggaaacaagaataatattgacagacctgctttttaagcagtatcttttccctctaatcagctgagtttgttggagctgatcattttatttcttcaactccattcaactataggtgcaaagaatgagaacttcagtgtaactccaattttctaagagaactaatcatattgctgctttataaaaaaggtaatctttcacagttgcttagatttatgaataattagatttaaagcattatactggaatctagaaatctagctaaaagagctgaggttcttatctgaattatttgggccgttagccttctgttgaactatagaaagaacttaaagatatagttgtaaaataaggacgtactccccaaaactgtcccaagtatccacttgattctgtatctttatattgcatctttttctcatatttctgcaagtttacataaactctggtcaactatgaatgcctcccgggatgagaaatgggagtttgggtgaaatagattagagaataggttttggggtttttttnaaccacatactctcttgtcaactttcaagttttgtgcttgtacctcttccaaagtattcatttgaaaatatttcatttttgaaatcagaaaggcactgtctgtgctctctctccgccagatactcagtctgggttacaggaagtagaaatttgtgactactagcctttcccagcctcctttgtaactcttgactttggaaatgggaattcagccactgagaactttttgatgtgcagctgcctttctcagggaacactaaccaagaaacaaagtcttcaggtcacctttcctcttccttttgtgaggacaggagacaaaagaacaagatctccctgaagtgtctccttggctttacaacattccacagtaggcacctaacacttgagttaaatgtgcagactacacacctaccataaaattagggcactcaaggtaaggaaagtatttccatagttacttggatatttggcagagtagttttctctcttaaactactaattgcccataacttgctgggtgtgtacacaacctgtaggaagtattatttttaaaagttancggctgggngtggtggctcncgtttgtaattctagcactttgtgaggccgaggtgggcggnncacctgaggtcaggagttcgagtccaacctggccaacatggtgaaccccgtctctactaaaaaaaatacaaaaaattagctgggcatggtgctcatgcctgtaatcccagctactggggatggtgaggcaggagaatcacttgaacctgggaggcagaggttgtggtgagccagaattnngccactgcactccagcctgggcaacagagcaagactccgtgtcaaaaaaaaaaaaaagttatcaacataaacaaattctcatagcagaatcaagaaaattcaaatacaggaaactgaatcaactttaaagaaagagaatcattattaaagagtgtaagaaaagcagagagcagcagattctataatttttattacaaaaaaaaccctttacatgctatgacattaaatgtcacttataaggtcattgcaagcaaatctttttaaaaaatatacatactgtatatatttacattcaagtttgaataatatttgtcaagatatagttcagattctactctttacccattctgtggatttgttcatctagtaactaaacagcgattgtatcatcactcaggcacatagagaggtagaaaccgcttttttaaagaaaaaaaaactggagtgcaaatgtgaagatcactgaagcagcttagctacatcaaggagaccctaactagctttggtcatctcaaaaagctgaatatatgtagccttgtcctttaaattaaaaccagaaaaactttgggcaggtgctcttctgagcacatcagagtgctgacagaactcagcaactaatggtctgccactctgcaacgcgaattgcacatgactaagtgaggcaaagatagcagcggagctgggctggcagctgggcaccttttccctgataagacacaaatcataaccaaacaagtggcttacaagacagtcaattaatatctggacatatagtctggaactcggaagccaactaaagtacttcatttcccaagtgaaatccctattcatttttgttctcccacctccatcccaaactgagctcctaagtctagatagggatgggggtcgcctgggacttctgcaggccacagtttttcggccccaantaccggcctcacgaaggctcttgggactgagaagggctgccggggttcttgataaacttagtgggggttgttccagagaggggaagttggaggggagccacaggaatggccgtggccagaagcccttctcgttcccttttcttctgtttcatcctgcggttctggaaccagattttgacttgcgtgtcattcaggtgcaagcagttggctatctcgatgcgccgggctcgag

SEQ ID NO: 287704 - DNA, 1723 bp, Homo sapiens
gggcgggggggtggggggaaaaggggaggtgggaggggcccgggagaggaggggcgtctgcccttgtttcccccgttaacgtttaatttgggaacgagatgcccggggatgcaaccagccccgcgctcggaggcggcggtcggagttccgtgcgcagagggcacacaaaagcctcgaggatcattgcctcgaccccatcccccaccgcgcggcgacgccccctacgggctgggacacctccaccctcggactgctgccgggtttccctccggctgcgaccctggagagtttgccatctccgtaccaccaccaccaccacacacagcaccctcaagactccctgtgatcctgggatgcactcaacgaagagtgtgtggcccaggatttgatggaaatgctacaagagaagcaggctctccccttctgaaatgatgagtgataatgaccatacaggtcaacttttccaccacttggagggagcctgtcaaagaacaaaggcaacagagaagagagcagagctgaggttgggtgagagggagaaattcctgagtgcttgaatcccacatgccggaagccgcaccacacttggacttctcaatacaggagccactgagaaaccaagtcatgctgaagacctggaaatcccagcaggctgcaaaccagctgcaactacaatgggtcagcccttttgagatgctgctgactacccacttatctgccaagttagccagtgttaagccatggattcaccacgctcagataaaacctgcccctctgggatccctccagaaaaaaacaggcatgctgttgtgaaccctaagatggccttaagttaatattcaatgcccagccaaagaccctaaataagaagtcataaaggaaacatgtgcttttcaggtaccaatcaccctccagatctaagaatggcttcaggctggggctgcagtcacctctttgcccagcttctcccctgccctattctgcttcacttgcatccttaaaggttccacccaagagctcttctacaagaaagcacctataaagccagacacattggcttatgcctataatcctagcactttgggaggccaaggtaggaggatggcttgaggccaggagttcaagaccagcctgggcaacttggtgaggccccgtctctataaaaaataaaaaaattaaccaggtgtggtggtgcacgtctctagtctcagctactcaggaggctgtggcaggaagatggcttgagcccaggaggttgaggctgcagtgaactgagatcatgccactgcacccatcttgggcaacagaatgagatcctgtctctaaaaaaataaaaacaatttacaacagtaagcacctgtacacaagccccatctccagtcctgtttctagggcttccaatttaacacacctagaggctgggcatagtagctcatgcctgtaatcccaatactttgggaggctgaggcaagtgaagcacttgaggtcaggagttcgagaccagcctggccaacatggcaaaaccccatctctactaaaaatgcaaacattagctgggcatggtggcacatgcctgtaatcccagctactcgggaggctgagacaggagaatcacttgaacccaggaggtggaggttacagtgagccaagatcacaccactgtaccacagcctgagcaacgaaagaagactctgtctaaaaaaagtaaaaaataaaataaaac

SEQ ID NO: 287705 - DNA, 538 bp, Homo sapiens
gatggctcctccgccgaccccgcggtcccccactggctccgcgtcccttccccgccattcccggagggctcaaggcaccgcagggtcatgagagaagggtcaccgcggcaaagacaggtggccgcccgagctggggtcagagaagggttcgcgtccttccttgaagtcagtgcgaatcccaaaacgagtccctgcggggtgtccgaaatggtggcagagagagaagggatggggctctttctccccagatcctggaggacggatgacaaagtccctcgcagccgcggtcacccactgatcgcctgccgcgggcgcccgagctgcgggcacggggtatcctgaggctgtgcacccgggaccccggcgcgcactgtccgcgggccacgcggtgagggtggctgcgggcgagagggctcatgcttcaggggaagcccaaggcccgccagccgcggcggctgcgacgagacttggcaagagttaaacgtcggtcccaggagcagcgagtgcgcgcgacttcccagaccgacgcgcctccctt

SEQ ID NO: 287706 - DNA, 748 bp, Homo sapiens
agaatctagagaccagaggtcacaaaccacctgcctatcgggaccatatttgactcactcagagtgttctggttggtatgccaggattctctaaagaaaatgtgaactaaattgagatttcatctccaaagagaaccagatttctgctttctcttaatcagccataaggtctgtcaatactgggtcccatttcctcaaggcagtgatcaactgaagcagaggagtgagtgcctgccttagaaggcatgtgccctcccgtttgcccaatcctcacccgccccaaggtctccccaacactgagcattgcttgccttttgtcatcacccttgcattactgtttcttatggtggagagatatttatttggacccaagtctctaccagaagtgacgaaataaaagacagacccagaaggctgaatatgtcagaataaaagggagaaggcatatttctctgtggaagaaaataatattcctctgtgtttaagagactgggttctcacacctgatgtatttcattcttctatattcccacctagctctgcaggcatttattggcaggctacacctaagactttctctgcagaaaaatgttctagatgcacagatttgggggcttgattgacaacctgacacctcactctaaatccgcatgggtctgttgacctcaggtgagaacacttgttctaagggagtggaaggtctttattaagataaccctgagaaataaaagtctgccttgagcattgt

SEQ ID NO: 287707 - DNA, 385 bp, Homo sapiens
gggcgggggggtggggggaaaaggggaggtgggaggggcccgggagaggaggggcgtctgcccttgtttcccccgttaacgtttaatttgggaacgagatgcccggggatgcaaccagccccgcgctcggaggcggcggtcggagttccgtgcgcagagggcacacaaaagcctcgaggatcattgcctcgaccccatcccccaccgcgcggcgacgccccctacgggctgggacacctccaccctcggactgctgccgggtttccctccggctgcgaccctggaggtgggaaggagagagggagggagggaggaaggagcgagggcgggaggcaggccggtggggaggagcgggagatcaggttattaggaggattattaattt

SEQ ID NO: 287708 - DNA, 1627 bp, Homo sapiens
gggcgggggggtggggggaaaaggggaggtgggaggggcccgggagaggaggggcgtctgcccttgtttcccccgttaacgtttaatttgggaacgagatgcccggggatgcaaccagccccgcgctcggaggcggcggtcggagttccgtgcgcagagggcacacaaaagcctcgaggatcattgcctcgaccccatcccccaccgcgcggcgacgccccctacgggctgggacacctccaccctcggactgctgccgggtttccctccggctgcgaccctggaggatttgatggaaatgctacaagagaagcaggctctccccttctgaaatgatgagtgataatgaccatacaggtcaacttttccaccacttggagggagcctgtcaaagaacaaaggcaacagagaagagagcagagctgaggttgggtgagagggagaaattcctgagtgcttgaatcccacatgccggaagccgcaccacacttggacttctcaatacaggagccactgagaaaccaagtcatgctgaagacctggaaatcccagcaggctgcaaaccagctgcaactacaatgggtcagcccttttgagatgctgctgactacccacttatctgccaagttagccagtgttaagccatggattcaccacgctcagataaaacctgcccctctgggatccctccagaaaaaaacaggcatgctgttgtgaaccctaagatggccttaagttaatattcaatgcccagccaaagaccctaaataagaagtcataaaggaaacatgtgcttttcaggtaccaatcaccctccagatctaagaatggcttcaggctggggctgcagtcacctctttgcccagcttctcccctgccctattctgcttcacttgcatccttaaaggttccacccaagagctcttctacaagaaagcacctataaagccagacacattggcttatgcctataatcctagcactttgggaggccaaggtaggaggatggcttgaggccaggagttcaagaccagcctgggcaacttggtgaggccccgtctctataaaaaataaaaaaattaaccaggtgtggtggtgcacgtctctagtctcagctactcaggaggctgtggcaggaagatggcttgagcccaggaggttgaggctgcagtgaactgagatcatgccactgcacccatcttgggcaacagaatgagatcctgtctctaaaaaaataaaaacaatttacaacagtaagcacctgtacacaagccccatctccagtcctgtttctagggcttccaatttaacacacctagaggctgggcatagtagctcatgcctgtaatcccaatactttgggaggctgaggcaagtgaagcacttgaggtcaggagttcgagaccagcctggccaacatggcaaaaccccatctctactaaaaatgcaaacattagctgggcatggtggcacatgcctgtaatcccagctactcgggaggctgagacaggagaatcacttgaacccaggaggtggaggttacagtgagccaagatcacaccactgtaccacagcctgagcaacgaaagaagactctgtctaaaaaaagtaaaaaataaaataaaac

SEQ ID NO: 287709 - DNA, 1594 bp, Homo sapiens
cgcctccctccccagtcagcgctccgctcgcgccccgcccggctgctgcggaggcggctttccaggaactttccaggaatcggcctcacgtgaccgcgggccccgctactgctttaaagaggctcggtcgcaatacacaggcttcagggaagaccggagtttgccatctccgtaccaccaccaccaccacacacagcaccctcaagactccctgtgatcctgggatgcactcaacgaagagtgtgtggcccaggatttgatggaaatgctacaagagaagcaggctctccccttctgaaatgatgagtgataatgaccatacaggtcaacttttccaccacttggagggagcctgtcaaagaacaaaggcaacagagaagagagcagagctgaggttgggtgagagggagaaattcctgagtgcttgaatcccacatgccggaagccgcaccacacttggacttctcaatacaggagccactgagaaaccaagtcatgctgaagacctggaaatcccagcaggctgcaaaccagctgcaactacaatgggtcagcccttttgagatgctgctgactacccacttatctgccaagttagccagtgttaagccatggattcaccacgctcagataaaacctgcccctctgggatccctccagaaaaaaacaggcatgctgttgtgaaccctaagatggccttaagttaatattcaatgcccagccaaagaccctaaataagaagtcataaaggaaacatgtgcttttcaggtaccaatcaccctccagatctaagaatggcttcaggctggggctgcagtcacctctttgcccagcttctcccctgccctattctgcttcacttgcatccttaaaggttccacccaagagctcttctacaagaaagcacctataaagccagacacattggcttatgcctataatcctagcactttgggaggccaaggtaggaggatggcttgaggccaggagttcaagaccagcctgggcaacttggtgaggccccgtctctataaaaaataaaaaaattaaccaggtgtggtggtgcacgtctctagtctcagctactcaggaggctgtggcaggaagatggcttgagcccaggaggttgaggctgcagtgaactgagatcatgccactgcacccatcttgggcaacagaatgagatcctgtctctaaaaaaataaaaacaatttacaacagtaagcacctgtacacaagccccatctccagtcctgtttctagggcttccaatttaacacacctagaggctgggcatagtagctcatgcctgtaatcccaatactttgggaggctgaggcaagtgaagcacttgaggtcaggagttcgagaccagcctggccaacatggcaaaaccccatctctactaaaaatgcaaacattagctgggcatggtggcacatgcctgtaatcccagctactcgggaggctgagacaggagaatcacttgaacccaggaggtggaggttacagtgagccaagatcacaccactgtaccacagcctgagcaacgaaagaagactctgtctaaaaaaagtaaaaaataaaataaaac

SEQ ID NO: 287710 - DNA, 1463 bp, Homo sapiens
gcggccgcgcctcgccgccctccccgagtttgccatctccgtaccaccaccaccaccacacacagcaccctcaagactccctgtgatcctgggatgcactcaacgaagagtgtgtggcccaggatttgatggaaatgctacaagagaagcaggctctccccttctgaaatgatgagtgataatgaccatacaggtcaacttttccaccacttggagggagcctgtcaaagaacaaaggcaacagagaagagagcagagctgaggttgggtgagagggagaaattcctgagtgcttgaatcccacatgccggaagccgcaccacacttggacttctcaatacaggagccactgagaaaccaagtcatgctgaagacctggaaatcccagcaggctgcaaaccagctgcaactacaatgggtcagcccttttgagatgctgctgactacccacttatctgccaagttagccagtgttaagccatggattcaccacgctcagataaaacctgcccctctgggatccctccagaaaaaaacaggcatgctgttgtgaaccctaagatggccttaagttaatattcaatgcccagccaaagaccctaaataagaagtcataaaggaaacatgtgcttttcaggtaccaatcaccctccagatctaagaatggcttcaggctggggctgcagtcacctctttgcccagcttctcccctgccctattctgcttcacttgcatccttaaaggttccacccaagagctcttctacaagaaagcacctataaagccagacacattggcttatgcctataatcctagcactttgggaggccaaggtaggaggatggcttgaggccaggagttcaagaccagcctgggcaacttggtgaggccccgtctctataaaaaataaaaaaattaaccaggtgtggtggtgcacgtctctagtctcagctactcaggaggctgtggcaggaagatggcttgagcccaggaggttgaggctgcagtgaactgagatcatgccactgcacccatcttgggcaacagaatgagatcctgtctctaaaaaaataaaaacaatttacaacagtaagcacctgtacacaagccccatctccagtcctgtttctagggcttccaatttaacacacctagaggctgggcatagtagctcatgcctgtaatcccaatactttgggaggctgaggcaagtgaagcacttgaggtcaggagttcgagaccagcctggccaacatggcaaaaccccatctctactaaaaatgcaaacattagctgggcatggtggcacatgcctgtaatcccagctactcgggaggctgagacaggagaatcacttgaacccaggaggtggaggttacagtgagccaagatcacaccactgtaccacagcctgagcaacgaaagaagactctgtctaaaaaaagtaaaaaataaaataaaac

SEQ ID NO: 287711 - DNA, 691 bp, Homo sapiens
cgcctccctccccagtcagcgctccgctcgcgccccgcccggctgctgcggaggcggctttccaggaactttccaggaatcggcctcacgtgaccgcgggccccgctactgctttaaagaggctcggtcgcaatacacaggcttcagggaagaccggagtttgccatctccgtaccaccaccaccaccacacacagcaccctcaagactccctgtgatcctgggatgcactcaacgaagagtgtgtggcccaggatttgatggaaatgctacaagagaagcaggctctccccttctgaaatgatgagtgataatgaccatacaggtcaacttttccaccacttggagggagcctgtcaaagaacaaaggcaacagagaagagagcagagctgaggttgggtgagagggagaaattcctgagtgcttgaatcccacatgccggaagccgcaccacacttggacttctcaatacaggagccactctgcaggcatttattggcaggctacacctaagactttctctgcagaaaaatgttctagatgcacagatttgggggcttgattgacaacctgacacctcactctaaatccgcatgggtctgttgacctcaggtgagaacacttgttctaagggagtggaaggtctttattaagataaccctgagaaataaaagtctgccttgagcattgt

SEQ ID NO: 287712 - DNA, 631 bp, Homo sapiens
cgcctccctccccagtcagcgctccgctcgcgccccgcccggctgctgcggaggcggctttccaggaactttccaggaatcggcctcacgtgaccgcgggccccgctactgctttaaagaggctcggtcgcaatacacaggcttcagggaagaccggagtttgccatctccgtaccaccaccaccaccacacacagcaccctcaagactccctgtgatcctgggatgcactcaacgaagagtgtgtggcccaggatttgatggaaatgctacaagagaagcaggctctccccttctgaaatgatgagtgataatgaccatacaggtcaacttttccaccacttggagggagcctgtcaaagaacaaaggcaacagagaagagagcagagctgaggttgggtgagagggagaaattcctgagtgcttgaatcccacatgccggaagccgcaccacacttggacttctcaatacaggagccaaaaccaaggcaaatttaatattaggcatggcgagagggcagaaggtgagagtagggaagtctactagccagggactcaggagcacaaggctggggtcccaagcttggtttccatagagaagtcccatttctgggccttctagtttccttag

SEQ ID NO: 287713 - DNA, 351 bp, Homo sapiens
cctctgcccaacaagagtcttctcattagcaaaagagtaatttccaagggtgttaggagctctatgctgggaaccagggaccaagagtaaatatatattttgtattttaccacaggtaccaatcaccctccagatctaagaatggcttcaggctggggctgcagtcacctctttgcccagcttctcccctgccctattctgcttcacttgcatccttaaaggttccacccaagagctcttctacaagaaagcacctataaagccagacacattggcttatgcctataatcctagcactttgggaggccaaggtaggaggatggcttgaggccaggagttcaagaccagcct

SEQ ID NO: 287714 - DNA, 447 bp, Homo sapiens
gtaactctcctcggggcggagccttcgggcttcccccactaccggtacctgccgcgggcgcccgagctgcgggcacggggtatcctgaggctgtgcacccgggaccccggcgcgcactgtccgcgggccacgcggtgagggtggctgcgggcgagagggctcatgcttcaggggaagcccaaggcccgccagccgcggcggctgcgacgagacttggcaagagttaaacgtcggtcccaggagcagcgagtgcgcgcgacttcccagaccgacgcgcctcccttgctccccgcctccctccccagtcagcgctccgctcgcgccccgcccggctgctgcggaggcggctttccaggaactttccaggaatcggcctcacgtgaccgcgggccccgctactgctttaaagaggctcggtcgcaatacacaggcttcagggaagaccgg

SEQ ID NO: 287715 - DNA, 5745 bp, Homo sapiens
cacagggcctgcagagaggggacccaccgggcaggatgcactggcttccagcaggccacgacatcaacggtgccctggagccctccaacatagacaccagcatcctggaggagtacatcagcaaggaggatgcctccgacctctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccaggcacactgccggactctcccccagactcgggctccgaggcctactccccccagcaggtgaatgagccccacctcctgcgcacgataacccctgagacactgtgccacgtgggagtgccctcccgcctggagcatccgcccccacctccagcccacttgccaggccccccgccacccccaccacccccacctcactaccctgtcctgcagcgggatctgtacatgaaggccgagcccccgatcccccactacgctgccatggggcaggggctggtgcccactgatcttcaccacacccagcagtcccagatgctgcaccagctcctgcagcagcacggagctgagctccctacacacccctccaagaagaggaagcactctgaatcccccccgagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggcctcctgcaggacagtgacagcctcagtggctcctacctggaccccaactaccagtccatcaagtggcagcctcatcagcagaacaagtgggcgaccctgtacgatgctaactacaaggagctgcccatgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggagtgaagctggaggccctgaaccagtccattaacatcgagcagtcccagtcagaccggagcaagcggcccttcaacccggtcacggtcaatctgccccctgagcaggtcacgaaggtgactgtggggcggctgcacttcagcgagaccaccgctaacaacatgcgtaagaagggcaagcccaacccggaccagaggtacttcatgctggtggtggccctccaggctcatgcacagaaccagaactacacgctggccgcccagatctcagagcgcatcattgtgcgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggaggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccgtgaattcacctaccacttccgggtggcactgctgggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaaagggcttcagggaaggtaagtgggccacctgctggaagctgccagctgcccggctggcaatggtgtgagtgtcttggccctgtccctgccctggggtccagcaggtcatccctcccttcttctctctcctttggcgtttgttcctgtagtcactgggctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctga

SEQ ID NO: 287716 - DNA, 411 bp, Homo sapiens
gtgaggactaaatgggatgatctacgtaaggctgcaggcctgattcctgatccttattctgtgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcaggtacttgctgcacccctgacactacccagcccagcctggcaaggctcactggccagggcccacctcagcccagtcatgtgactgtctgggt

SEQ ID NO: 287717 - DNA, 5826 bp, Homo sapiens
cacagggcctgcagagaggggacccaccgggcaggatgcactggcttccagcaggccacgacatcaacggtgccctggagccctccaacatagacaccagcatcctggaggagtacatcagcaaggaggatgcctccgacctctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccaggcacactgccggactctcccccagactcgggctccgaggcctactccccccagcaggtgaatgagccccacctcctgcgcacgataacccctgagacactgtgccacgtgggagtgccctcccgcctggagcatccgcccccacctccagcccacttgccaggccccccgccacccccaccacccccacctcactaccctgtcctgcagcgggatctgtacatgaaggccgagcccccgatcccccactacgctgccatggggcaggggctggtgcccactgatcttcaccacacccagcagtcccagatgctgcaccagctcctgcagcagcacggagctgagctccctacacacccctccaagaagaggaagcactctgaatcccccccgagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggcctcctgcaggacagtgacagcctcagtggctcctacctggaccccaactaccagtccatcaagtggcagcctcatcagcagaacaagtgggcgaccctgtacgatgctaactacaaggagctgcccatgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggagtgaagctggaggccctgaaccagtccattaacatcgagcagtcccagtcagaccggagcaagcggcccttcaacccggtcacggtcaatctgccccctgagcaggtcacgaaggtgactgtggggcggctgcacttcagcgagaccaccgctaacaacatgcgtaagaagggcaagcccaacccggaccagaggtacttcatgctggtggtggccctccaggctcatgcacagaaccagaactacacgctggccgcccagatctcagagcgcatcattgtgcgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggctcttttgccgtgtccacttcctgtctcctggccctgctccggccccagccccctggggggagtgaggccttgtgcccatgaggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccgtgaattcacctaccacttccgggtggcactgctgggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaaagggcttcagggaaggtaagtgggccacctgctggaagctgccagctgcccggctggcaatggtgtgagtgtcttggccctgtccctgccctggggtccagcaggtcatccctcccttcttctctctcctttggcgtttgttcctgtagtcactgggctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctga

SEQ ID NO: 287718 - DNA, 3625 bp, Homo sapiens
aagtactaaccaggcccgaccctgcttagcttccgagatcagacgagatcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggaggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccgtgaattcacctaccacttccgggtggcactgctgggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaaagggcttcagggaaggtaagtgggccacctgctggaagctgccagctgcccggctggcaatggtgtgagtgtcttggccctgtccctgccctggggtccagcaggtcatccctcccttcttctctctcctttggcgtttgttcctgtagtcactgggctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctga

SEQ ID NO: 287719 - DNA, 1115 bp, Homo sapiens
aatacatagccggtacccttccaaagaggtggcagcatacacagggcaaggacagcaattcccttcccatttctggacccatggcagacatggctaaatgaatactacactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaaagggcttcagggaaggtaagtgggccacctgctggaagctgccagctgcccggctggcaatggtgtgagtgtcttggccctgtccctgccctggggtccagcaggtcatccctcccttcttctctctcctttggcgtttgttcctgtagtcactgggctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctga

SEQ ID NO: 287720 - DNA, 5498 bp, Homo sapiens
cacagggcctgcagagaggggacccaccgggcaggatgcactggcttccagcaggccacgacatcaacggtgccctggagccctccaacatagacaccagcatcctggaggagtacatcagcaaggaggatgcctccgacctctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccaggcacactgccggactctcccccagactcgggctccgaggcctactccccccagcaggtgaatgagccccacctcctgcgcacgataacccctgagacactgtgccacgtgggagtgccctcccgcctggagcatccgcccccacctccagcccacttgccaggccccccgccacccccaccacccccacctcactaccctgtcctgcagcgggatctgtacatgaaggccgagcccccgatcccccactacgctgccatggggcaggggctggtgcccactgatcttcaccacacccagcagtcccagatgctgcaccagctcctgcagcagcacggagctgagctccctacacacccctccaagaagaggaagcactctgaatcccccccgagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggcctcctgcaggacagtgacagcctcagtggctcctacctggaccccaactaccagtccatcaagtggcagcctcatcagcagaacaagtgggcgaccctgtacgatgctaactacaaggagctgcccatgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggagtgaagctggaggccctgaaccagtccattaacatcgagcagtcccagtcagaccggagcaagcggcccttcaacccggtcacggtcaatctgccccctgagcaggtcacgaaggtgactgtggggcggctgcacttcagcgagaccaccgctaacaacatgcgtaagaagggcaagcccaacccggaccagaggtacttcatgctggtggtggccctccaggctcatgcacagaaccagaactacacgctggccgcccagatctcagagcgcatcattgtgcgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggaggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccgtgaattcacctaccacttccgggtggcactgctgggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctga

SEQ ID NO: 287721 - DNA, 5290 bp, Homo sapiens
  misc_feature (5022)..(5023): n is a, c, g, or t
cacagggcctgcagagaggggacccaccgggcaggatgcactggcttccagcaggccacgacatcaacggtgccctggagccctccaacatagacaccagcatcctggaggagtacatcagcaaggaggatgcctccgacctctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccaggcacactgccggactctcccccagactcgggctccgaggcctactccccccagcaggtgaatgagccccacctcctgcgcacgataacccctgagacactgtgccacgtgggagtgccctcccgcctggagcatccgcccccacctccagcccacttgccaggccccccgccacccccaccacccccacctcactaccctgtcctgcagcgggatctgtacatgaaggccgagcccccgatcccccactacgctgccatggggcaggggctggtgcccactgatcttcaccacacccagcagtcccagatgctgcaccagctcctgcagcagcacggagctgagctccctacacacccctccaagaagaggaagcactctgaatcccccccgagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggcctcctgcaggacagtgacagcctcagtggctcctacctggaccccaactaccagtccatcaagtggcagcctcatcagcagaacaagtgggcgaccctgtacgatgctaactacaaggagctgcccatgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggagtgaagctggaggccctgaaccagtccattaacatcgagcagtcccagtcagaccggagcaagcggcccttcaacccggtcacggtcaatctgccccctgagcaggtcacgaaggtgactgtggggcggctgcacttcagcgagaccaccgctaacaacatgcgtaagaagggcaagcccaacccggaccagaggtacttcatgctggtggtggccctccaggctcatgcacagaaccagaactacacgctggccgcccagatctcagagcgcatcattgtgcgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggaggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccgtgaattcacctaccacttccgggtggcactgctgggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccaccnntgccgccaattttccaaaaaagcctggctcctcttttcctgttcctccatccaagcccccaaagatctctaaccagaaataaacaggaagactcagtgatttacaaaagacattttagttttacacgtacagaaaattctacccagcattacagaattcttagacttcttaaattcctgattttccttggtatttacattttgataagggagccaatggttcttcaaacatttgaaaagaacacatacagtcgacgcggccgcgaat

SEQ ID NO: 287722 - DNA, 5237 bp, Homo sapiens
cacagggcctgcagagaggggacccaccgggcaggatgcactggcttccagcaggccacgacatcaacggtgccctggagccctccaacatagacaccagcatcctggaggagtacatcagcaaggaggatgcctccgacctctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccaggcacactgccggactctcccccagactcgggctccgaggcctactccccccagcaggtgaatgagccccacctcctgcgcacgataacccctgagacactgtgccacgtgggagtgccctcccgcctggagcatccgcccccacctccagcccacttgccaggccccccgccacccccaccacccccacctcactaccctgtcctgcagcgggatctgtacatgaaggccgagcccccgatcccccactacgctgccatggggcaggggctggtgcccactgatcttcaccacacccagcagtcccagatgctgcaccagctcctgcagcagcacggagctgagctccctacacacccctccaagaagaggaagcactctgaatcccccccgagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggcctcctgcaggacagtgacagcctcagtggctcctacctggaccccaactaccagtccatcaagtggcagcctcatcagcagaacaagtgggcgaccctgtacgatgctaactacaaggagctgcccatgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggagtgaagctggaggccctgaaccagtccattaacatcgagcagtcccagtcagaccggagcaagcggcccttcaacccggtcacggtcaatctgccccctgagcaggtcacgaaggtgactgtggggcggctgcacttcagcgagaccaccgctaacaacatgcgtaagaagggcaagcccaacccggaccagaggtacttcatgctggtggtggccctccaggctcatgcacagaaccagaactacacgctggccgcccagatctcagagcgcatcattgtgcgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggaggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccgtgaattcacctaccacttccgggtggcactgctgggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctcccttcttctctctcctttggcgtttgttcctgtagtcactgggctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctga

SEQ ID NO: 287723 - DNA, 1050 bp, Homo sapiens
cacagggcctgcagagaggggacccaccgggcaggatgcactggcttccagcaggccacgacatcaacggtgccctggagccctccaacatagacaccagcatcctggaggagtacatcagcaaggaggatgcctccgacctctgcttccctgacatctctgctccagccagctcggcctcctactcccacgggcagcctgcgatgcctggctccagcggggtccaccacctgagcccccctgggggtggaccctccccggggcgccatggtcccctcccacccccgggctacggcaccccgctgaactgcaacaacaacaacggcatgggcgctgcccccaagcccttcccggggggcaccgggccccccatcaaggctgagcccaaggctccctatgccccaggcacactgccggactctcccccagactcgggctccgaggcctactccccccagcaggtgaatgagccccacctcctgcgcacgataacccctgagacactgtgccacgtgggagtgccctcccgcctggagcatccgcccccacctccagcccacttgccaggccccccgccacccccaccacccccacctcactaccctgtcctgcagcgggatctgtacatgaaggccgagcccccgatcccccactacgctgccatggggcaggggctggtgcccactgatcttcaccacacccagcagtcccagatgctgcaccagctcctgcagcagcacggagctgagctccctacagaccccaggcggcatgccgtctgcagggacaggcgccacggaggccagcctcacaagggcatgtctgcatggtggaaagatggaattaggcctgggacacaccccgcccaccctacgggtgtatcccaaatgccgccggccgcacactcaggccgcaccatctgagccccctcctctgagaggcagggcacagacagggccgaggggcagtggagatgggaacaggaggggggctcagaccatgaaaacattggagaatcttagcgggactttggcctgatccatacagata

SEQ ID NO: 287724 - DNA, 131 bp, Homo sapiens
ggggcacccccttaaccgctcctccgacctccagcagagcccactggggacagcctcagcctggccctctttgcatttgcacttttcctcttggtcctcagtcatcgtccgtggttccggaccaggcctgc

SEQ ID NO: 287725 - DNA, 320 bp, Homo sapiens
cctctcagcattgcccgtgtccagacaccgccttggcacccgccaggtgccccctccccaggtacatggctggccaactcttcaaggtggggtgtgggacccaaggtgcagggcccacatgggcgttccctccctccaggcctcctgcaggacagtgacagcctcagtggctcctacctggaccccaactaccagtccatcaagtggcagcctcatcagcagaacaagtgggcgaccctgtacgatgctaactacaaggagctgtgagtgccctacaacactccccactcctccaggcccccccaccttgggacgcccca

SEQ ID NO: 287726 - DNA, 6832 bp, Homo sapiens
agcgcgacctttgacctgcagtagagcctacgtcagaggctggcgcaaacagaagtgcagcggtggcggcggctggttgcgggccggcggcgggctggcggagatggaggatcttgttcaagatggggtggcttcaccagctacccctgggaccgggaaatctaagaattggagaaagaaattgaagaactcagatcaaaacctgttactgaaggaactggtgatattattaaggcattaactgaacgtctggatgctcttcttctggaaaaagcagagactgagcaacagtgtctttctctgaaaaaggaaaatataaaaatgaagcaagaggttgaggattctgtaacaaagatgggagatgcacataaggagttggaacaatcacatataaactatgtgaaagaaattgaaaatttgaaaaatgagttgatggcagtacgttccaaatacagtgaagacaaagctaacttacaaaagcagctggaagaagcaatgaatacgcaattagaactttcagaacaacttaaatttcagaacaactctgaagataatgttaaaaaactacaagaagagattgagaaaattaggccaggctttgaggagcaaattttatatctgcaaaagcaattagacgctaccactgatgaaaagaaggaaacagttactcaactccaaaatatcattgaggctaattctcagcattaccaaaaaaatattaatagtttgcaggaagagcttttacagttgaaagctatacaccaagaagaggtgaaagagttgatgtgccagattgaagcatcagctaaggaacatgaagcagagataaataagttgaacgagctaaaagagaacttagtaaaacaatgtgaggcaagtgaaaagaacatccagaagaaatatgaatgtgagttagaaaatttaaggaaagccacctcaaatgcaaaccaagacaatcagatatgttctattctcttgcaagaaaatacatttgtagaacaagtagtaaatgaaaaagtcaaacacttagaagataccttaaaagaacttgaatctcaacacagtatcttaaaagatgaggtaacttatatgaataatcttaagttaaaacttgaaatggatgctcaacatataaaggatgagttttttcatgaacgggaagacttagagtttaaaattaatgaattattactagctaaagaagaacagggctgtgtaattgaaaaattaaaatctgagctagcaggtttaaataaacagttttgctatactgtagaacagcataacagagaagtacagagtcttaaggaacaacatcaaaaagaaatatcagaactaaatgagacatttttgtcagattcagaaaaagaaaaattaacattaatgtttgaaatacagggtcttaaggaacagtgtgaaaacctacagcaagaaaagcaagaagcaattttaaattatgagagtttacgagagattatggaaattttacaaacagaactgggggaatctgctggaaaaataagtcaagagttcgaatcaatgaagcaacagcaagcatctgatgttcatgaactgcagcagaagctcagaactgcttttactgaaaaagatgcccttctcgaaactgtgaatcgcctccagggagaaaatgaaaagttactatctcaacaagaattggtaccagaacttgaaaataccataaagaaccttcaagaaaagaatggagtatacttacttagtctcagtcaaagagataccatgttaaaagaattagaaggaaagataaattctcttactgaggaaaaagatgattttataaataaactgaaaaattcccatgaagaaatggataatttccataagaaatgtgaaagggaagaaagattgattcttgaacttgggaagaaagtagagcaaacaatccagtacaacagtgaactagaacaaaaggtaaatgaattaacaggaggactagaggagactttaaaagaaaaggatcaaaatgaccaaaaactagaaaaacttatggttcaaatgaaagttctctctgaagacaaagaagtattgtcagctgaagtgaagtctctttatgaggaaaacaataaactcagttcagaaaaaaaacagttgagtagggatttggaggtttttttgtctcaaaaagaagatgttatccttaaagaacatattactcaattagaaaagaaacttcagttaatggttgaagagcaagataatttaaataaactgcttgaaaatgagcaagttcagaagttatttgttaaaactcagttgtatggttttcttaaagaaatgggatcagaagtttcagaagacagtgaagagaaagatgttgttaatgtcctacaggcagtcggtgaatccttggcaaaaataaatgaggaaaaatgcaacctggcttttcagcgtgatgaaaaagtattagagttagaaaaagagattaagtgccttcaagaagagagtgtagttcagtgtgaagaacttaagtctttattgagagactatgagcaagagaaagttctcttaaggaaagagttagaagaaatacagtcagaaaaagaggccctgcagtctgatcttctagaaatgaagaatgctaatgaaaaaacaaggcttgaaaatcagaatcttttaattcaagttgaagaagtatctcaaacatgtagcaaaagtgaaatccataatgaaaaagaaaaatgttttataaaggaacatgaaaacctaaagccactactagaacaaaaagaattacgagataggagagcagagttgatactattaaaggattccttagcaaaatcaccttctgtaaaaaatgatcctctgtcttcagtaaaagagttggaagaaaaaatagaaaatctggaaaaagaatgcaaagaaaaggaggagaaaataaataagataaaattagttgccgtaaaggcaaagaaagaactagattccagcagaaaagagacccagactgtgaaggaagaacttgaatctcttcgatcagaaaaggaccagttatctgcttccatgagagatctcattcaaggagcagaaagctataagaatcttttattagaatatgaaaagcagtcagagcaactggatgtggaaaaagaacgtgctaataattttgagcatcgtattgaagaccttacaagacaattaagaaattcgactttgcagtgtgaaacaataaattctgataatgaagatctcctggctcgtattgagacattacagtctaatgccaaattattagaagtacagattttagaagtccagagagccaaagcaatggtagacaaagaattagaagctgaaaaacttcagaaagaacagaagataaaggaacatgccactactgtaaatgaacttgaagaacttcaggtacaacttcaaaaggaaaagaaacagcttcagaaaaccatgcaagaattagagctggttaaaaaggatgcccaacaaaccacattgatgaatatggaaatagctgattatgaacgtttgatgaaagaactaaatcaaaagttaactaataaaaacaacaagatagaagatttggagcaagaaataaaaattcaaaaacagaaacaagaaaccctacaagaagaaataacttcattacagtcttcagtacaacaatatgaagaaaaaaacaccaaaatcaagcaattgcttgtgaaaaccaaaaaggaactggcagattcaaagcaagcagaaactgatcacttaatacttcaagcatctttaaaaggtgagctggaggcaagccagcagcaagtagaagtctataaaatacagctggctgaaataacatcagagaagcacaaaatccacgagcacctgaaaacctctgcggaacagcaccagcgtacgctaagtgcataccagcagagagtgacagcactacaggaagagtgccgtgctgccaaggcagaacaagctactgtaacctctgaattcgagagctacaaagtccgagttcataatgttctaaaacaacagaaaaataaatctatgtctcaggctgaaactgagggcgctaaacaagaaagggaacatctggaaatgctgattgaccagctaaaaatcaaattacaagatagccaaaataacttacagattaatgtatctgaacttcaaacattgcagtctgaacatgatacactgctagaaaggcacaacaagatgctgcaggaaactgtgtccaaagaggcggaactccgggaaaaattgtgttcaatacagtcagagaacatgatgatgaaatctgaacatacacagactgtgagtcagctaacatcccagaacgaggtccttcgaaatagcttccgagatcaagtgcgacatttgcaggaagaacacagaaagacagtggagacattacagcagcagctctccaagatggaagcacagctcttccagcttaagaatgaaccgaccacaagaagcccagtttcctctcaacaatctttgaagaaccttcgagaaaggagaaacacagacctcccgcttctagacatgcacactgtaacccgggaagagggagaaggcatggagacaactgatacggagtctgtgtcttccgccagcacatacacacagtctttagagcagctgcttaactctcccgaaactaaacttgagcctccattatggcatgctgaatttaccaaagaagaattggttcagaagctcagttccaccacaaaaagtgcagatcacttaaacggcctgcttcgggaaacagaagcaaccaatgcaattcttatggagcaaattaagcttctcaaaagtgaaataagaagattggaaaggaatcaagagcgagagaagtctgcagctaacctggaatacttgaagaacgtcttgctgcagttcattttcttgaaaccaggtagtgaaagagagagacttcttcctgttataaatacgatgttgcagctcagccctgaagaaaagggaaaacttgctgcggttgctcaaggtgaggaagaaaatgcttcccgttcttctggatgggcatcctatcttcatagttggtctggacttcgataggttgatggaaggaatatttttattaaccaaatagaatctatttacaaaaatggttcacgtatattaccacaattcttttgtcaaaaagtgtgtatatatgtttgcatctacatatatttgtacatctatatgacagatgtattttaaaagtttcatcttgaagtaaaagtacaacagcttgaagtgttgatagcaggccacagccctctaactcatgtgatttcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaattgcttgaggctagtgagctgtgactcccactgcactccagctcggggaacagagcgagaccttgtctctaaaaataatagtaataaaataaaaataacgttttatgactatttattgcaaggtcagagttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactatctcaaaactcattatgttgtcagagccctagagctggctagtgtaacactgactatgagtaggtgggcccaccacttgaggtgatttcatggtgtctttccaggctcttgatagggtgtcactgcatgcaagccatgaatctgttttgagaatcctctccattttcccaaataaaaacctatcacaacagtgactatatcactcagcattggatctaaatataaaagtggtgctttcagtgtttttggcagatagtgttccataagctttccatcagaagggattttagacaccttagaggtccgtgctacatcgtcacagttcctccgaataaccttaggtggtagtgttacttgcctttgacacctctgcatatgttttaatgactagatccaaactgtgttgttcttaaatcaaaaattggataatttgtaatatttatgtgttaatcacacagtatgctctctgaagttctcttaagccttcagtttatactcttaatttaattttctttctgagctggagaactggctttgcactttggttacacagaacattggtttccaattcagtttaactgaaatttgctgctgatatgttgagtttgttctttaaaaaatagctcatatatctcatctttcctcctgtcttagaagaacagacctaactagtgaatgtattaatgaaaatgcatctatttcagagctgacatgaagagtttagtttttttactttataaactgtgaatatgagtatgccagctgcatacgatgtaactaatcatatttaaatatatttcactttctctttgactttagaccttttgaagtctgtataaacttgttttgaaatatagtctctgcttacgaatgtcataacaaaataattttttgcatgataaaaaattactttgattacaaaaggcatattctttcatggtttctgcaatgagaggaagtgtaatgattattttaatatttctattaaatatgtttaa

SEQ ID NO: 287727 - DNA, 610 bp, Homo sapiens
gggtggttttttaaatccaaaaaatggggaaaaattgggaaaaaatttaggggggtaaaccccccaggaaaggcccctctgaagttctcttaagccttcagtttatactcttaatttaattttctttctgagctggagaactggctttgcactttggttacacagaacattggtttccaattcagtttaactgaaatttgctgctgatatgttgagtttgttctttaaaaaatagctcatatatctcatctttcctcctgtcttagaagaacagacctaactagtgaatgtattaatgaaaatgcatctatttcagagctgacatgaagagtttagtttttttactttataaactgtgaatatgagtatgccagctgcatacgatgtaactaatcatatttaaatatatttcactttctctttgactttagaccttttgaagtctgtataaacttgttttgaaatatagtctctgcttacgaatgtcataacaaaataattttttgcatgataaaaaattactttgattacaaaaggcatattctttcatggtttctgcaatgagaggaagtgtaatgattattttaatatttctattaaatatgtttaa

SEQ ID NO: 287728 - DNA, 764 bp, Homo sapiens
tgtaggaattctctttgatagtgattttcttatgcttaacatgatggccagttcattatggaaaatgaattctgattctggtttttgttttgttttgtgtttttttttcccctgtaaaatctaggattccttagcaaaatcaccttctgtaaaaaatgatcctctgtcttcagtaaaagagttggaagaaaaaataggtaactatggttttgcagatgttgtcacaattaattagacagattcttgttagtgttagaatagattgggaaatatagtagccaaataatgagttgttaaaaacacagttcgtagctgtcttttcctcgagctcacattcttgcccctctaacacctgtttgccttctctttcaaaagtgttactttctattgtttaacccaagcaagattggtgtgatttataaatggcttcatgatttattttggatttttcattcatttagcaaattttatttaaatgcccaactattctagaccctggtgatagaaaagtggttgaggtacagaccatgtgctcagagatctcactgttgtttgaggtgtggacaagatacagtactaacagcataggaacttaacactgttttgagttaaaaaaaaaaaaaaaagcagcgtagaatagggttttcagccaagtcttgaagaatgagaaattttacacaggaagaaaggtattctaggaagaaggaagagcaggtgcttgtaggttgacatatagcatacatcaaggcacgtactaggaagtt

SEQ ID NO: 287729 - DNA, 749 bp, Homo sapiens
agcgcgacctttgacctgcagtagagcctacgtcagaggctggcgcaaacagaagtgcagcggtggcggcggctggttgcgggccggcggcgggctggcggagatggaggatcttgttcaagatggggtggcttcaccagctacccctgggaccgggaaatctaagaattggagaaagaaattgaagaactcagatcaaaacctgttactgaaggaactggtgatattattaagagtcttgctctgtcgcccaggctggagtgcaatgacgtgatctcggctcactgcaacctctacctcctgggttcaagcgattctcctgcctcaagctcgcattaactgaacgtctggatgctcttcttctggaaaaagcagagactgagcaacagtgtctttctctgaaaaaggaaaatataaaaatgaagcaagaggttgagctataatgccatctttactaaaagcgaaaaaaagtaagttgattttcacacatgactaaataccattatctctttagttctacggtattcagaggcatttcttgcctatttcttgcctattaggtctgggctaatttgagtaatagatttaatattgtagatatatattgtcatactttagataggcagcacctaaggagagttattggaatatcagtatcatgtttctccaaatacatttctgctcatttacttttctctctacttagcttgtggctaatatttttcctaaggtcagaggctccttttgtc

SEQ ID NO: 287730 - DNA, 299 bp, Homo sapiens
ataatttatttatgagtaacattaaaaaaaatttaaccaagattctcattctataggaaactgatcacttaatacttcaagcatctttaaaaggtgagctggaggggtccgctcgtcagaagctgcagctggagaaggctcgacgacagaggccaaaatgaagaaatttgaagacggacctgctgctcctggaagaccagaattccgagctgagcgaggagcgggagctgctgggagatcgtctggccgagttctcatcccaggccgctgaggaggaggagtccgcctcccggcctcat

SEQ ID NO: 287731 - DNA, 6917 bp, Homo sapiens
agcgcgacctttgacctgcagtagagcctacgtcagaggctggcgcaaacagaagtgcagcggtggcggcggctggttgcgggccggcggcgggctggcggagatggaggatcttgttcaagatggggtggcttcaccagctacccctgggaccgggaaatctaagctggaaacattgcccaaagaagacctcatcaagtttgccaagaaacagatgatgctaatacagaaagctaaatcaaggtgtacagaattggagaaagaaattgaagaactcagatcaaaacctgttactgaaggaactggtgatattattaaggcattaactgaacgtctggatgctcttcttctggaaaaagcagagactgagcaacagtgtctttctctgaaaaaggaaaatataaaaatgaagcaagaggttgaggattctgtaacaaagatgggagatgcacataaggagttggaacaatcacatataaactatgtgaaagaaattgaaaatttgaaaaatgagttgatggcagtacgttccaaatacagtgaagacaaagctaacttacaaaagcagctggaagaagcaatgaatacgcaattagaactttcagaacaacttaaatttcagaacaactctgaagataatgttaaaaaactacaagaagagattgagaaaattaggccaggctttgaggagcaaattttatatctgcaaaagcaattagacgctaccactgatgaaaagaaggaaacagttactcaactccaaaatatcattgaggctaattctcagcattaccaaaaaaatattaatagtttgcaggaagagcttttacagttgaaagctatacaccaagaagaggtgaaagagttgatgtgccagattgaagcatcagctaaggaacatgaagcagagataaataagttgaacgagctaaaagagaacttagtaaaacaatgtgaggcaagtgaaaagaacatccagaagaaatatgaatgtgagttagaaaatttaaggaaagccacctcaaatgcaaaccaagacaatcagatatgttctattctcttgcaagaaaatacatttgtagaacaagtagtaaatgaaaaagtcaaacacttagaagataccttaaaagaacttgaatctcaacacagtatcttaaaagatgaggtaacttatatgaataatcttaagttaaaacttgaaatggatgctcaacatataaaggatgagttttttcatgaacgggaagacttagagtttaaaattaatgaattattactagctaaagaagaacagggctgtgtaattgaaaaattaaaatctgagctagcaggtttaaataaacagttttgctatactgtagaacagcataacagagaagtacagagtcttaaggaacaacatcaaaaagaaatatcagaactaaatgagacatttttgtcagattcagaaaaagaaaaattaacattaatgtttgaaatacagggtcttaaggaacagtgtgaaaacctacagcaagaaaagcaagaagcaattttaaattatgagagtttacgagagattatggaaattttacaaacagaactgggggaatctgctggaaaaataagtcaagagttcgaatcaatgaagcaacagcaagcatctgatgttcatgaactgcagcagaagctcagaactgcttttactgaaaaagatgcccttctcgaaactgtgaatcgcctccagggagaaaatgaaaagttactatctcaacaagaattggtaccagaacttgaaaataccataaagaaccttcaagaaaagaatggagtatacttacttagtctcagtcaaagagataccatgttaaaagaattagaaggaaagataaattctcttactgaggaaaaagatgattttataaataaactgaaaaattcccatgaagaaatggataatttccataagaaatgtgaaagggaagaaagattgattcttgaacttgggaagaaagtagagcaaacaatccagtacaacagtgaactagaacaaaaggtaaatgaattaacaggaggactagaggagactttaaaagaaaaggatcaaaatgaccaaaaactagaaaaacttatggttcaaatgaaagttctctctgaagacaaagaagtattgtcagctgaagtgaagtctctttatgaggaaaacaataaactcagttcagaaaaaaaacagttgagtagggatttggaggtttttttgtctcaaaaagaagatgttatccttaaagaacatattactcaattagaaaagaaacttcagttaatggttgaagagcaagataatttaaataaactgcttgaaaatgagcaagttcagaagttatttgttaaaactcagttgtatggttttcttaaagaaatgggatcagaagtttcagaagacagtgaagagaaagatgttgttaatgtcctacaggcagtcggtgaatccttggcaaaaataaatgaggaaaaatgcaacctggcttttcagcgtgatgaaaaagtattagagttagaaaaagagattaagtgccttcaagaagagagtgtagttcagtgtgaagaacttaagtctttattgagagactatgagcaagagaaagttctcttaaggaaagagttagaagaaatacagtcagaaaaagaggccctgcagtctgatcttctagaaatgaagaatgctaatgaaaaaacaaggcttgaaaatcagaatcttttaattcaagttgaagaagtatctcaaacatgtagcaaaagtgaaatccataatgaaaaagaaaaatgttttataaaggaacatgaaaacctaaagccactactagaacaaaaagaattacgagataggagagcagagttgatactattaaaggattccttagcaaaatcaccttctgtaaaaaatgatcctctgtcttcagtaaaagagttggaagaaaaaatagaaaatctggaaaaagaatgcaaagaaaaggaggagaaaataaataagataaaattagttgccgtaaaggcaaagaaagaactagattccagcagaaaagagacccagactgtgaaggaagaacttgaatctcttcgatcagaaaaggaccagttatctgcttccatgagagatctcattcaaggagcagaaagctataagaatcttttattagaatatgaaaagcagtcagagcaactggatgtggaaaaagaacgtgctaataattttgagcatcgtattgaagaccttacaagacaattaagaaattcgactttgcagtgtgaaacaataaattctgataatgaagatctcctggctcgtattgagacattacagtctaatgccaaattattagaagtacagattttagaagtccagagagccaaagcaatggtagacaaagaattagaagctgaaaaacttcagaaagaacagaagataaaggaacatgccactactgtaaatgaacttgaagaacttcaggtacaacttcaaaaggaaaagaaacagcttcagaaaaccatgcaagaattagagctggttaaaaaggatgcccaacaaaccacattgatgaatatggaaatagctgattatgaacgtttgatgaaagaactaaatcaaaagttaactaataaaaacaacaagatagaagatttggagcaagaaataaaaattcaaaaacagaaacaagaaaccctacaagaagaaataacttcattacagtcttcagtacaacaatatgaagaaaaaaacaccaaaatcaagcaattgcttgtgaaaaccaaaaaggaactggcagattcaaagcaagcagaaactgatcacttaatacttcaagcatctttaaaaggtgagctggaggcaagccagcagcaagtagaagtctataaaatacagctggctgaaataacatcagagaagcacaaaatccacgagcacctgaaaacctctgcggaacagcaccagcgtacgctaagtgcataccagcagagagtgacagcactacaggaagagtgccgtgctgccaaggcagaacaagctactgtaacctctgaattcgagagctacaaagtccgagttcataatgttctaaaacaacagaaaaataaatctatgtctcaggctgaaactgagggcgctaaacaagaaagggaacatctggaaatgctgattgaccagctaaaaatcaaattacaagatagccaaaataacttacagattaatgtatctgaacttcaaacattgcagtctgaacatgatacactgctagaaaggcacaacaagatgctgcaggaaactgtgtccaaagaggcggaactccgggaaaaattgtgttcaatacagtcagagaacatgatgatgaaatctgaacatacacagactgtgagtcagctaacatcccagaacgaggtccttcgaaatagcttccgagatcaagtgcgacatttgcaggaagaacacagaaagacagtggagacattacagcagcagctctccaagatggaagcacagctcttccagcttaagaatgaaccgaccacaagaagcccagtttcctctcaacaatctttgaagaaccttcgagaaaggagaaacacagacctcccgcttctagacatgcacactgtaacccgggaagagggagaaggcatggagacaactgatacggagtctgtgtcttccgccagcacatacacacagtctttagagcagctgcttaactctcccgaaactaaacttgagcctccattatggcatgctgaatttaccaaagaagaattggttcagaagctcagttccaccacaaaaagtgcagatcacttaaacggcctgcttcgggaaacagaagcaaccaatgcaattcttatggagcaaattaagcttctcaaaagtgaaataagaagattggaaaggaatcaagagcgagagaagtctgcagctaacctggaatacttgaagaacgtcttgctgcagttcattttcttgaaaccaggtagtgaaagagagagacttcttcctgttataaatacgatgttgcagctcagccctgaagaaaagggaaaacttgctgcggttgctcaaggtgaggaagaaaatgcttcccgttcttctggatgggcatcctatcttcatagttggtctggacttcgataggttgatggaaggaatatttttattaaccaaatagaatctatttacaaaaatggttcacgtatattaccacaattcttttgtcaaaaagtgtgtatatatgtttgcatctacatatatttgtacatctatatgacagatgtattttaaaagtttcatcttgaagtaaaagtacaacagcttgaagtgttgatagcaggccacagccctctaactcatgtgatttcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaattgcttgaggctagtgagctgtgactcccactgcactccagctcggggaacagagcgagaccttgtctctaaaaataatagtaataaaataaaaataacgttttatgactatttattgcaaggtcagagttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactatctcaaaactcattatgttgtcagagccctagagctggctagtgtaacactgactatgagtaggtgggcccaccacttgaggtgatttcatggtgtctttccaggctcttgatagggtgtcactgcatgcaagccatgaatctgttttgagaatcctctccattttcccaaataaaaacctatcacaacagtgactatatcactcagcattggatctaaatataaaagtggtgctttcagtgtttttggcagatagtgttccataagctttccatcagaagggattttagacaccttagaggtccgtgctacatcgtcacagttcctccgaataaccttaggtggtagtgttacttgcctttgacacctctgcatatgttttaatgactagatccaaactgtgttgttcttaaatcaaaaattggataatttgtaatatttatgtgttaatcacacagtatgctctctgaagttctcttaagccttcagtttatactcttaatttaattttctttctgagctggagaactggctttgcactttggttacacagaacattggtttccaattcagtttaactgaaatttgctgctgatatgttgagtttgttctttaaaaaatagctcatatatctcatctttcctcctgtcttagaagaacagacctaactagtgaatgtattaatgaaaatgcatctatttcagagctgacatgaagagtttagtttttttactttataaactgtgaatatgagtatgccagctgcatacgatgtaactaatcatatttaaatatatttcactttctctttgactttagaccttttgaagtctgtataaacttgttttgaaatatagtctctgcttacgaatgtcataacaaaataattttttgcatgataaaaaattactttgattacaaaaggcatattctttcatggtttctgcaatgagaggaagtgtaatgattattttaatatttctattaaatatgtttaa

SEQ ID NO: 287732 - DNA, 6552 bp, Homo sapiens
gataaaaatgaagcaagaggttgatgctataatgccatctttactaaaagcgaaaaaaagattctgtaacaaagatgggagatgcacataaggagttggaacaatcacatataaactatgtgaaagaaattgaaaatttgaaaaatgagttgatggcagtacgttccaaatacagtgaagacaaagctaacttacaaaagcagctggaagaagcaatgaatacgcaattagaactttcagaacaacttaaatttcagaacaactctgaagataatgttaaaaaactacaagaagagattgagaaaattaggccaggctttgaggagcaaattttatatctgcaaaagcaattagacgctaccactgatgaaaagaaggaaacagttactcaactccaaaatatcattgaggctaattctcagcattaccaaaaaaatattaatagtttgcaggaagagcttttacagttgaaagctatacaccaagaagaggtgaaagagttgatgtgccagattgaagcatcagctaaggaacatgaagcagagataaataagttgaacgagctaaaagagaacttagtaaaacaatgtgaggcaagtgaaaagaacatccagaagaaatatgaatgtgagttagaaaatttaaggaaagccacctcaaatgcaaaccaagacaatcagatatgttctattctcttgcaagaaaatacatttgtagaacaagtagtaaatgaaaaagtcaaacacttagaagataccttaaaagaacttgaatctcaacacagtatcttaaaagatgaggtaacttatatgaataatcttaagttaaaacttgaaatggatgctcaacatataaaggatgagttttttcatgaacgggaagacttagagtttaaaattaatgaattattactagctaaagaagaacagggctgtgtaattgaaaaattaaaatctgagctagcaggtttaaataaacagttttgctatactgtagaacagcataacagagaagtacagagtcttaaggaacaacatcaaaaagaaatatcagaactaaatgagacatttttgtcagattcagaaaaagaaaaattaacattaatgtttgaaatacagggtcttaaggaacagtgtgaaaacctacagcaagaaaagcaagaagcaattttaaattatgagagtttacgagagattatggaaattttacaaacagaactgggggaatctgctggaaaaataagtcaagagttcgaatcaatgaagcaacagcaagcatctgatgttcatgaactgcagcagaagctcagaactgcttttactgaaaaagatgcccttctcgaaactgtgaatcgcctccagggagaaaatgaaaagttactatctcaacaagaattggtaccagaacttgaaaataccataaagaaccttcaagaaaagaatggagtatacttacttagtctcagtcaaagagataccatgttaaaagaattagaaggaaagataaattctcttactgaggaaaaagatgattttataaataaactgaaaaattcccatgaagaaatggataatttccataagaaatgtgaaagggaagaaagattgattcttgaacttgggaagaaagtagagcaaacaatccagtacaacagtgaactagaacaaaaggtaaatgaattaacaggaggactagaggagactttaaaagaaaaggatcaaaatgaccaaaaactagaaaaacttatggttcaaatgaaagttctctctgaagacaaagaagtattgtcagctgaagtgaagtctctttatgaggaaaacaataaactcagttcagaaaaaaaacagttgagtagggatttggaggtttttttgtctcaaaaagaagatgttatccttaaagaacatattactcaattagaaaagaaacttcagttaatggttgaagagcaagataatttaaataaactgcttgaaaatgagcaagttcagaagttatttgttaaaactcagttgtatggttttcttaaagaaatgggatcagaagtttcagaagacagtgaagagaaagatgttgttaatgtcctacaggcagtcggtgaatccttggcaaaaataaatgaggaaaaatgcaacctggcttttcagcgtgatgaaaaagtattagagttagaaaaagagattaagtgccttcaagaagagagtgtagttcagtgtgaagaacttaagtctttattgagagactatgagcaagagaaagttctcttaaggaaagagttagaagaaatacagtcagaaaaagaggccctgcagtctgatcttctagaaatgaagaatgctaatgaaaaaacaaggcttgaaaatcagaatcttttaattcaagttgaagaagtatctcaaacatgtagcaaaagtgaaatccataatgaaaaagaaaaatgttttataaaggaacatgaaaacctaaagccactactagaacaaaaagaattacgagataggagagcagagttgatactattaaaggattccttagcaaaatcaccttctgtaaaaaatgatcctctgtcttcagtaaaagagttggaagaaaaaatagaaaatctggaaaaagaatgcaaagaaaaggaggagaaaataaataagataaaattagttgccgtaaaggcaaagaaagaactagattccagcagaaaagagacccagactgtgaaggaagaacttgaatctcttcgatcagaaaaggaccagttatctgcttccatgagagatctcattcaaggagcagaaagctataagaatcttttattagaatatgaaaagcagtcagagcaactggatgtggaaaaagaacgtgctaataattttgagcatcgtattgaagaccttacaagacaattaagaaattcgactttgcagtgtgaaacaataaattctgataatgaagatctcctggctcgtattgagacattacagtctaatgccaaattattagaagtacagattttagaagtccagagagccaaagcaatggtagacaaagaattagaagctgaaaaacttcagaaagaacagaagataaaggaacatgccactactgtaaatgaacttgaagaacttcaggtacaacttcaaaaggaaaagaaacagcttcagaaaaccatgcaagaattagagctggttaaaaaggatgcccaacaaaccacattgatgaatatggaaatagctgattatgaacgtttgatgaaagaactaaatcaaaagttaactaataaaaacaacaagatagaagatttggagcaagaaataaaaattcaaaaacagaaacaagaaaccctacaagaagaaataacttcattacagtcttcagtacaacaatatgaagaaaaaaacaccaaaatcaagcaattgcttgtgaaaaccaaaaaggaactggcagattcaaagcaagcagaaactgatcacttaatacttcaagcatctttaaaaggtgagctggaggcaagccagcagcaagtagaagtctataaaatacagctggctgaaataacatcagagaagcacaaaatccacgagcacctgaaaacctctgcggaacagcaccagcgtacgctaagtgcataccagcagagagtgacagcactacaggaagagtgccgtgctgccaaggcagaacaagctactgtaacctctgaattcgagagctacaaagtccgagttcataatgttctaaaacaacagaaaaataaatctatgtctcaggctgaaactgagggcgctaaacaagaaagggaacatctggaaatgctgattgaccagctaaaaatcaaattacaagatagccaaaataacttacagattaatgtatctgaacttcaaacattgcagtctgaacatgatacactgctagaaaggcacaacaagatgctgcaggaaactgtgtccaaagaggcggaactccgggaaaaattgtgttcaatacagtcagagaacatgatgatgaaatctgaacatacacagactgtgagtcagctaacatcccagaacgaggtccttcgaaatagcttccgagatcaagtgcgacatttgcaggaagaacacagaaagacagtggagacattacagcagcagctctccaagatggaagcacagctcttccagcttaagaatgaaccgaccacaagaagcccagtttcctctcaacaatctttgaagaaccttcgagaaaggagaaacacagacctcccgcttctagacatgcacactgtaacccgggaagagggagaaggcatggagacaactgatacggagtctgtgtcttccgccagcacatacacacagtctttagagcagctgcttaactctcccgaaactaaacttgagcctccattatggcatgctgaatttaccaaagaagaattggttcagaagctcagttccaccacaaaaagtgcagatcacttaaacggcctgcttcgggaaacagaagcaaccaatgcaattcttatggagcaaattaagcttctcaaaagtgaaataagaagattggaaaggaatcaagagcgagagaagtctgcagctaacctggaatacttgaagaacgtcttgctgcagttcattttcttgaaaccaggtagtgaaagagagagacttcttcctgttataaatacgatgttgcagctcagccctgaagaaaagggaaaacttgctgcggttgctcaaggtgaggaagaaaatgcttcccgttcttctggatgggcatcctatcttcatagttggtctggacttcgataggttgatggaaggaatatttttattaaccaaatagaatctatttacaaaaatggttcacgtatattaccacaattcttttgtcaaaaagtgtgtatatatgtttgcatctacatatatttgtacatctatatgacagatgtattttaaaagtttcatcttgaagtaaaagtacaacagcttgaagtgttgatagcaggccacagccctctaactcatgtgatttcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaattgcttgaggctagtgagctgtgactcccactgcactccagctcggggaacagagcgagaccttgtctctaaaaataatagtaataaaataaaaataacgttttatgactatttattgcaaggtcagagttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactatctcaaaactcattatgttgtcagagccctagagctggctagtgtaacactgactatgagtaggtgggcccaccacttgaggtgatttcatggtgtctttccaggctcttgatagggtgtcactgcatgcaagccatgaatctgttttgagaatcctctccattttcccaaataaaaacctatcacaacagtgactatatcactcagcattggatctaaatataaaagtggtgctttcagtgtttttggcagatagtgttccataagctttccatcagaagggattttagacaccttagaggtccgtgctacatcgtcacagttcctccgaataaccttaggtggtagtgttacttgcctttgacacctctgcatatgttttaatgactagatccaaactgtgttgttcttaaatcaaaaattggataatttgtaatatttatgtgttaatcacacagtatgctctctgaagttctcttaagccttcagtttatactcttaatttaattttctttctgagctggagaactggctttgcactttggttacacagaacattggtttccaattcagtttaactgaaatttgctgctgatatgttgagtttgttctttaaaaaatagctcatatatctcatctttcctcctgtcttagaagaacagacctaactagtgaatgtattaatgaaaatgcatctatttcagagctgacatgaagagtttagtttttttactttataaactgtgaatatgagtatgccagctgcatacgatgtaactaatcatatttaaatatatttcactttctctttgactttagaccttttgaagtctgtataaacttgttttgaaatatagtctctgcttacgaatgtcataacaaaataattttttgcatgataaaaaattactttgattacaaaaggcatattctttcatggtttctgcaatgagaggaagtgtaatgattattttaatatttctattaaatatgtttaa

SEQ ID NO: 287733 - DNA, 6873 bp, Homo sapiens
agcgcgacctttgacctgcagtagagcctacgtcagaggctggcgcaaacagaagtgcagcggtggcggcggctggttgcgggccggcggcgggctggcggagatggaggatcttgttcaagatggggtggcttcaccagctacccctgggaccgggaaatctaagctggaaacattgcccaaagaagacctcatcaagtttgccaagaaacagatgatgctaatacagaaagctaaatcaaggtgtacagaattggagaaagaaattgaagaactcagatcaaaacctgttactgaaggaactggtgatattattaaggcattaactgaacgtctggatgctcttcttctggaaaaagcagagactgagcaacagtgtctttctctgaaaaaggaaaatataaaaatgaagcaagaggttgaggattctgtaacaaagatgggagatgcacataaggagttggaacaatcacatataaactatgtgaaagaaattgaaaatttgaaaaatgagttgatggcagtacgttccaaatacagtgaagacaaagctaacttacaaaagcagctggaagaagcaatgaatacgcaattagaactttcagaacaacttaaatttcagaacaactctgaagataatgttaaaaaactacaagaagagattgagaaaattaggccaggctttgaggagcaaattttatatctgcaaaagcaattagacgctaccactgatgaaaagaaggaaacagttactcaactccaaaatatcattgaggctaattctcagcattaccaaaaaaatattaatagtttgcaggaagagcttttacagttgaaagctatacaccaagaagaggtgaaagagttgatgtgccagattgaagcatcagctaaggaacatgaagcagagataaataagttgaacgagctaaaagagaacttagtaaaacaatgtgaggcaagtgaaaagaacatccagaagaaatatgaatgtgagttagaaaatttaaggaaagccacctcaaatgcaaaccaagacaatcagatatgttctattctcttgcaagaaaatacatttgtagaacaagtagtaaatgaaaaagtcaaacacttagaagataccttaaaagaacttgaatctcaacacagtatcttaaaagatgaggtaacttatatgaataatcttaagttaaaacttgaaatggatgctcaacatataaaggatgagttttttcatgaacgggaagacttagagtttaaaattaatgaattattactagctaaagaagaacagggctgtgtaattgaaaaattaaaatctgagctagcaggtttaaataaacagttttgctatactgtagaacagcataacagagaagtacagagtcttaaggaacaacatcaaaaagaaatatcagaactaaatgagacatttttgtcagattcagaaaaagaaaaattaacattaatgtttgaaatacagggtcttaaggaacagtgtgaaaacctacagcaagaaaagcaagaagcaattttaaattatgagagtttacgagagattatggaaattttacaaacagaactgggggaatctgctggaaaaataagtcaagagttcgaatcaatgaagcaacagcaagcatctgatgttcatgaactgcagcagaagctcagaactgcttttactgaaaaagatgcccttctcgaaactgtgaatcgcctccagggagaaaatgaaaagttactatctcaacaagaattggtaccagaacttgaaaataccataaagaaccttcaagaaaagaatggagtatacttacttagtctcagtcaaagagataccatgttaaaagaattagaaggaaagataaattctcttactgaggaaaaagatgattttataaataaactgaaaaattcccatgaagaaatggataatttccataagaaatgtgaaagggaagaaagattgattcttgaacttgggaagaaagtagagcaaacaatccagtacaacagtgaactagaacaaaaggtaaatgaattaacaggaggactagaggagactttaaaagaaaaggatcaaaatgaccaaaaactagaaaaacttatggttcaaatgaaagttctctctgaagacaaagaagtattgtcagctgaagtgaagtctctttatgaggaaaacaataaactcagttcagaaaaaaaacagttgagtagggatttggaggtttttttgtctcaaaaagaagatgttatccttaaagaacatattactcaattagaaaagaaacttcagttaatggttgaagagcaagataatttaaataaactgcttgaaaatgagcaagttcagaagttatttgttaaaactcagttgtatggttttcttaaagaaatgggatcagaagtttcagaagacagtgaagagaaagatgttgttaatgtcctacaggcagtcggtgaatccttggcaaaaataaatgaggaaaaatgcaacctggcttttcagcgtgatgaaaaagtattagagttagaaaaagagattaagtgccttcaagaagagagtgtagttcagtgtgaagaacttaagtctttattgagagactatgagcaagagaaagttctcttaaggaaagagttagaagaaatacagtcagaaaaagaggccctgcagtctgatcttctagaaatgaagaatgctaatgaaaaaacaaggcttgaaaatcagaatcttttaattcaagttgaagaagtatctcaaacatgtagcaaaagtgaaatccataatgaaaaagaaaaatgttttataaaggaacatgaaaacctaaagccactactagaacaaaaagaattacgagataggagagcagagttgatactattaaaggattccttagcaaaatcaccttctgtaaaaaatgatcctctgtcttcagtaaaagagttggaagaaaaaatagaaaatctggaaaaagaatgcaaagaaaaggaggagaaaataaataagataaaattagttgccgtaaaggcaaagaaagaactagattccagcagaaaagagacccagactgtgaaggaagaacttgaatctcttcgatcagaaaaggaccagttatctgcttccatgagagatctcattcaaggagcagaaagctataagaatcttttattagaatatgaaaagcagtcagagcaactggatgtggaaaaagaacgtgctaataattttgagcatcgtattgaagaccttacaagacaattaagaaattcgactttgcagtgtgaaacaataaattctgataatgaagatctcctggctcgtattgagacattacagtctaatgccaaattattagaagtacagattttagaagtccagagagccaaagcaatggtagacaaagaattagaagctgaaaaacttcagaaagaacagaagataaaggaacatgccactactgtaaatgaacttgaagaacttcaggtacaacttcaaaaggaaaagaaacagcttcagaaaaccatgcaagaattagagctggttaaaaagtgaacgtttgatgaaagaactaaatcaaaagttaactaataaaaacaacaagatagaagatttggagcaagaaataaaaattcaaaaacagaaacaagaaaccctacaagaagaaataacttcattacagtcttcagtacaacaatatgaagaaaaaaacaccaaaatcaagcaattgcttgtgaaaaccaaaaaggaactggcagattcaaagcaagcagaaactgatcacttaatacttcaagcatctttaaaaggtgagctggaggcaagccagcagcaagtagaagtctataaaatacagctggctgaaataacatcagagaagcacaaaatccacgagcacctgaaaacctctgcggaacagcaccagcgtacgctaagtgcataccagcagagagtgacagcactacaggaagagtgccgtgctgccaaggcagaacaagctactgtaacctctgaattcgagagctacaaagtccgagttcataatgttctaaaacaacagaaaaataaatctatgtctcaggctgaaactgagggcgctaaacaagaaagggaacatctggaaatgctgattgaccagctaaaaatcaaattacaagatagccaaaataacttacagattaatgtatctgaacttcaaacattgcagtctgaacatgatacactgctagaaaggcacaacaagatgctgcaggaaactgtgtccaaagaggcggaactccgggaaaaattgtgttcaatacagtcagagaacatgatgatgaaatctgaacatacacagactgtgagtcagctaacatcccagaacgaggtccttcgaaatagcttccgagatcaagtgcgacatttgcaggaagaacacagaaagacagtggagacattacagcagcagctctccaagatggaagcacagctcttccagcttaagaatgaaccgaccacaagaagcccagtttcctctcaacaatctttgaagaaccttcgagaaaggagaaacacagacctcccgcttctagacatgcacactgtaacccgggaagagggagaaggcatggagacaactgatacggagtctgtgtcttccgccagcacatacacacagtctttagagcagctgcttaactctcccgaaactaaacttgagcctccattatggcatgctgaatttaccaaagaagaattggttcagaagctcagttccaccacaaaaagtgcagatcacttaaacggcctgcttcgggaaacagaagcaaccaatgcaattcttatggagcaaattaagcttctcaaaagtgaaataagaagattggaaaggaatcaagagcgagagaagtctgcagctaacctggaatacttgaagaacgtcttgctgcagttcattttcttgaaaccaggtagtgaaagagagagacttcttcctgttataaatacgatgttgcagctcagccctgaagaaaagggaaaacttgctgcggttgctcaaggtgaggaagaaaatgcttcccgttcttctggatgggcatcctatcttcatagttggtctggacttcgataggttgatggaaggaatatttttattaaccaaatagaatctatttacaaaaatggttcacgtatattaccacaattcttttgtcaaaaagtgtgtatatatgtttgcatctacatatatttgtacatctatatgacagatgtattttaaaagtttcatcttgaagtaaaagtacaacagcttgaagtgttgatagcaggccacagccctctaactcatgtgatttcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaattgcttgaggctagtgagctgtgactcccactgcactccagctcggggaacagagcgagaccttgtctctaaaaataatagtaataaaataaaaataacgttttatgactatttattgcaaggtcagagttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactatctcaaaactcattatgttgtcagagccctagagctggctagtgtaacactgactatgagtaggtgggcccaccacttgaggtgatttcatggtgtctttccaggctcttgatagggtgtcactgcatgcaagccatgaatctgttttgagaatcctctccattttcccaaataaaaacctatcacaacagtgactatatcactcagcattggatctaaatataaaagtggtgctttcagtgtttttggcagatagtgttccataagctttccatcagaagggattttagacaccttagaggtccgtgctacatcgtcacagttcctccgaataaccttaggtggtagtgttacttgcctttgacacctctgcatatgttttaatgactagatccaaactgtgttgttcttaaatcaaaaattggataatttgtaatatttatgtgttaatcacacagtatgctctctgaagttctcttaagccttcagtttatactcttaatttaattttctttctgagctggagaactggctttgcactttggttacacagaacattggtttccaattcagtttaactgaaatttgctgctgatatgttgagtttgttctttaaaaaatagctcatatatctcatctttcctcctgtcttagaagaacagacctaactagtgaatgtattaatgaaaatgcatctatttcagagctgacatgaagagtttagtttttttactttataaactgtgaatatgagtatgccagctgcatacgatgtaactaatcatatttaaatatatttcactttctctttgactttagaccttttgaagtctgtataaacttgttttgaaatatagtctctgcttacgaatgtcataacaaaataattttttgcatgataaaaaattactttgattacaaaaggcatattctttcatggtttctgcaatgagaggaagtgtaatgattattttaatatttctattaaatatgtttaa

SEQ ID NO: 287734 - DNA, 6852 bp, Homo sapiens
agcgcgacctttgacctgcagtagagcctacgtcagaggctggcgcaaacagaagtgcagcggtggcggcggctggttgcgggccggcggcgggctggcggagatggaggatcttgttcaagatggggtggcttcaccagctacccctgggaccgggaaatctaagctggaaacattgcccaaagaagacctcatcaagtttgccaagaaacagatgatgctaatacagaaagctaaatcaaggtgtacagaattggagaaagaaattgaagaactcagatcaaaacctgttactgaaggaactggtgatattattaaggcattaactgaacgtctggatgctcttcttctggaaaaagcagagactgagcaacagtgtctttctctgaaaaaggaaaatataaaaatgaagcaagaggttgaggattctgtaacaaagatgggagatgcacataaggagttggaacaatcacatataaactatgtgaaagaaattgaaaatttgaaaaatgagttgatggcagtacgttccaaatacagtgaagacaaagctaacttacaaaagcagctggaagaagcaatgaatacgcaattagaactttcagaacaacttaaatttcagaacaactctgaagataatgttaaaaaactacaagaagagattgagaaaattaggccaggctttgaggagcaaattttatatctgcaaaagcaattagacgctaccactgatgaaaagaaggaaacagttactcaactccaaaatatcattgaggctaattctcagcattaccaaaaaaatattaatagtttgcaggaagagcttttacagttgaaagctatacaccaagaagaggtgaaagagttgatgtgccagattgaagcatcagctaaggaacatgaagcagagataaataagttgaacgagctaaaagagaacttagtaaaacaatgtgaggcaagtgaaaagaacatccagaagaaatatgaatgtgagttagaaaatttaaggaaagccacctcaaatgcaaaccaagacaatcagatatgttctattctcttgcaagaaaatacatttgtagaacaagtagtaaatgaaaaagtcaaacacttagaagataccttaaaagaacttgaatctcaacacagtatcttaaaagatgaggtaacttatatgaataatcttaagttaaaacttgaaatggatgctcaacatataaaggatgagttttttcatgaacgggaagacttagagtttaaaattaatgaattattactagctaaagaagaacagggctgtgtaattgaaaaattaaaatctgagctagcaggtttaaataaacagttttgctatactgtagaacagcataacagagaagtacagagtcttaaggaacaacatcaaaaagaaatatcagaactaaatgagacatttttgtcagattcagaaaaagaaaaattaacattaatgtttgaaatacagggtcttaaggaacagtgtgaaaacctacagcaagaaaagcaagaagcaattttaaattatgagagtttacgagagattatggaaattttacaaacagaactgggggaatctgctggaaaaataagtcaagagttcgaatcaatgaagcaacagcaagcatctgatgttcatgaactgcagcagaagctcagaactgcttttactgaaaaagatgcccttctcgaaactgtgaatcgcctccagggagaaaatgaaaagttactatctcaacaagaattggtaccagaacttgaaaataccataaagaaccttcaagaaaagaatggagtatacttacttagtctcagtcaaagagataccatgttaaaagaattagaaggaaagataaattctcttactgaggaaaaagatgattttataaataaactgaaaaattcccatgaagaaatggataatttccataagaaatgtgaaagggaagaaagattgattcttgaacttgggaagaaagtagagcaaacaatccagtacaacagtgaactagaacaaaaggtaaatgaattaacaggaggactagaggagactttaaaagaaaaggatcaaaatgaccaaaaactagaaaaacttatggttcaaatgaaagttctctctgaagacaaagaagtattgtcagctgaagtgaagtctctttatgaggaaaacaataaactcagttcagaaaaaaaacagttgagtagggatttggaggtttttttgtctcaaaaagaagatgttatccttaaagaacatattactcaattagaaaagaaacttcagttaatggttgaagagcaagataatttaaataaactgcttgaaaatgagcaagttcagaagttatttgttaaaactcagttgtatggttttcttaaagaaatgggatcagaagtttcagaagacagtgaagagaaagatgttgttaatgtcctacaggcagtcggtgaatccttggcaaaaataaatgaggaaaaatgcaacctggcttttcagcgtgatgaaaaagtattagagttagaaaaagagattaagtgccttcaagaagagagtgtagttcagtgtgaagaacttaagtctttattgagagactatgagcaagagaaagttctcttaaggaaagagttagaagaaatacagtcagaaaaagaggccctgcagtctgatcttctagaaatgaagaatgctaatgaaaaaacaaggcttgaaaatcagaatcttttaattcaagttgaagaagtatctcaaacatgtagcaaaagtgaaatccataatgaaaaagaaaaatgttttataaaggaacatgaaaacctaaagccactactagaacaaaaagaattacgagataggagagcagagttgatactattaaaggattccttagcaaaatcaccttctgtaaaaaatgatcctctgtcttcagtaaaagagttggaagaaaaaatagaaaatctggaaaaagaatgcaaagaaaaggaggagaaaataaataagataaaattagttgccgtaaaggcaaagaaagaactagattccagcagaaaagagacccagactgtgaaggaagaacttgaatctcttcgatcagaaaaggaccagttatctgcttccatgagagatctcattcaaggagcagaaagctataagaatcttttattagaatatgaaaagcagtcagagcaactggatgtggaaaaagaactgtgaaacaataaattctgataatgaagatctcctggctcgtattgagacattacagtctaatgccaaattattagaagtacagattttagaagtccagagagccaaagcaatggtagacaaagaattagaagctgaaaaacttcagaaagaacagaagataaaggaacatgccactactgtaaatgaacttgaagaacttcaggtacaacttcaaaaggaaaagaaacagcttcagaaaaccatgcaagaattagagctggttaaaaaggatgcccaacaaaccacattgatgaatatggaaatagctgattatgaacgtttgatgaaagaactaaatcaaaagttaactaataaaaacaacaagatagaagatttggagcaagaaataaaaattcaaaaacagaaacaagaaaccctacaagaagaaataacttcattacagtcttcagtacaacaatatgaagaaaaaaacaccaaaatcaagcaattgcttgtgaaaaccaaaaaggaactggcagattcaaagcaagcagaaactgatcacttaatacttcaagcatctttaaaaggtgagctggaggcaagccagcagcaagtagaagtctataaaatacagctggctgaaataacatcagagaagcacaaaatccacgagcacctgaaaacctctgcggaacagcaccagcgtacgctaagtgcataccagcagagagtgacagcactacaggaagagtgccgtgctgccaaggcagaacaagctactgtaacctctgaattcgagagctacaaagtccgagttcataatgttctaaaacaacagaaaaataaatctatgtctcaggctgaaactgagggcgctaaacaagaaagggaacatctggaaatgctgattgaccagctaaaaatcaaattacaagatagccaaaataacttacagattaatgtatctgaacttcaaacattgcagtctgaacatgatacactgctagaaaggcacaacaagatgctgcaggaaactgtgtccaaagaggcggaactccgggaaaaattgtgttcaatacagtcagagaacatgatgatgaaatctgaacatacacagactgtgagtcagctaacatcccagaacgaggtccttcgaaatagcttccgagatcaagtgcgacatttgcaggaagaacacagaaagacagtggagacattacagcagcagctctccaagatggaagcacagctcttccagcttaagaatgaaccgaccacaagaagcccagtttcctctcaacaatctttgaagaaccttcgagaaaggagaaacacagacctcccgcttctagacatgcacactgtaacccgggaagagggagaaggcatggagacaactgatacggagtctgtgtcttccgccagcacatacacacagtctttagagcagctgcttaactctcccgaaactaaacttgagcctccattatggcatgctgaatttaccaaagaagaattggttcagaagctcagttccaccacaaaaagtgcagatcacttaaacggcctgcttcgggaaacagaagcaaccaatgcaattcttatggagcaaattaagcttctcaaaagtgaaataagaagattggaaaggaatcaagagcgagagaagtctgcagctaacctggaatacttgaagaacgtcttgctgcagttcattttcttgaaaccaggtagtgaaagagagagacttcttcctgttataaatacgatgttgcagctcagccctgaagaaaagggaaaacttgctgcggttgctcaaggtgaggaagaaaatgcttcccgttcttctggatgggcatcctatcttcatagttggtctggacttcgataggttgatggaaggaatatttttattaaccaaatagaatctatttacaaaaatggttcacgtatattaccacaattcttttgtcaaaaagtgtgtatatatgtttgcatctacatatatttgtacatctatatgacagatgtattttaaaagtttcatcttgaagtaaaagtacaacagcttgaagtgttgatagcaggccacagccctctaactcatgtgatttcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaattgcttgaggctagtgagctgtgactcccactgcactccagctcggggaacagagcgagaccttgtctctaaaaataatagtaataaaataaaaataacgttttatgactatttattgcaaggtcagagttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactatctcaaaactcattatgttgtcagagccctagagctggctagtgtaacactgactatgagtaggtgggcccaccacttgaggtgatttcatggtgtctttccaggctcttgatagggtgtcactgcatgcaagccatgaatctgttttgagaatcctctccattttcccaaataaaaacctatcacaacagtgactatatcactcagcattggatctaaatataaaagtggtgctttcagtgtttttggcagatagtgttccataagctttccatcagaagggattttagacaccttagaggtccgtgctacatcgtcacagttcctccgaataaccttaggtggtagtgttacttgcctttgacacctctgcatatgttttaatgactagatccaaactgtgttgttcttaaatcaaaaattggataatttgtaatatttatgtgttaatcacacagtatgctctctgaagttctcttaagccttcagtttatactcttaatttaattttctttctgagctggagaactggctttgcactttggttacacagaacattggtttccaattcagtttaactgaaatttgctgctgatatgttgagtttgttctttaaaaaatagctcatatatctcatctttcctcctgtcttagaagaacagacctaactagtgaatgtattaatgaaaatgcatctatttcagagctgacatgaagagtttagtttttttactttataaactgtgaatatgagtatgccagctgcatacgatgtaactaatcatatttaaatatatttcactttctctttgactttagaccttttgaagtctgtataaacttgttttgaaatatagtctctgcttacgaatgtcataacaaaataattttttgcatgataaaaaattactttgattacaaaaggcatattctttcatggtttctgcaatgagaggaagtgtaatgattattttaatatttctattaaatatgtttaa

SEQ ID NO: 287735 - DNA, 6859 bp, Homo sapiens
agcgcgacctttgacctgcagtagagcctacgtcagaggctggcgcaaacagaagtgcagcggtggcggcggctggttgcgggccggcggcgggctggcggagatggaggatcttgttcaagatggggtggcttcaccagctacccctgggaccgggaaatctaagctggaaacattgcccaaagaagacctcatcaagtttgccaagaaacagatgatgctaatacagaaagctaaatcaaggtgtacagaattggagaaagaaattgaagaactcagatcaaaacctgttactgaaggaactggtgatattattaaggcattaactgaacgtctggatgctcttcttctggaaaaagcagagactgagcaacagtgtctttctctgaaaaaggaaaatataaaaatgaagcaagaggttgaggattctgtaacaaagatgggagatgcacataaggagttggaacaatcacatataaactatgtgaaagaaattgaaaatttgaaaaatgagttgatggcagtacgttccaaatacagtgaagacaaagctaacttacaaaagcagctggaagaagcaatgaatacgcaattagaactttcagaacaacttaaatttcagaacaactctgaagataatgttaaaaaactacaagaagagattgagaaaattaggccaggctttgaggagcaaattttatatctgcaaaagcaattagacgctaccactgatgaaaagaaggaaacagttactcaactccaaaatatcattgaggctaattctcagcattaccaaaaaaatattaatagtttgcaggaagagcttttacagttgaaagctatacaccaagaagaggtgaaagagttgatgtgccagattgaagcatcagctaaggaacatgaagcagagataaataagttgaacgagctaaaagagaacttagtaaaacaatgtgaggcaagtgaaaagaacatccagaagaaatatgaatgtgagttagaaaatttaaggaaagccacctcaaatgcaaaccaagacaatcagatatgttctattctcttgcaagaaaatacatttgtagaacaagtagtaaatgaaaaagtcaaacacttagaagataccttaaaagaacttgaatctcaacacagtatcttaaaagatgaggtaacttatatgaataatcttaagttaaaacttgaaatggatgctcaacatataaaggatgagttttttcatgaacgggaagacttagagtttaaaattaatgaattattactagctaaagaagaacagggctgtgtaattgaaaaattaaaatctgagctagcaggtttaaataaacagttttgctatactgtagaacagcataacagagaagtacagagtcttaaggaacaacatcaaaaagaaatatcagaactaaatgagacatttttgtcagattcagaaaaagaaaaattaacattaatgtttgaaatacagggtcttaaggaacagtgtgaaaacctacagcaagaaaagcaagaagcaattttaaattatgagagtttacgagagattatggaaattttacaaacagaactgggggaatctgctggaaaaataagtcaagagttcgaatcaatgaagcaacagcaagcatctgatgttcatgaactgcagcagaagctcagaactgcttttactgaaaaagatgcccttctcgaaactgtgaatcgcctccagggagaaaatgaaaagttactatctcaacaagaattggtaccagaacttgaaaataccataaagaaccttcaagaaaagaatggagtatacttacttagtctcagtcaaagagataccatgttaaaagaattagaaggaaagataaattctcttactgaggaaaaagatgattttataaataaactgaaaaattcccatgaagaaatggataatttccataagaaatgtgaaagggaagaaagattgattcttgaacttgggaagaaagtagagcaaacaatccagtacaacagtgaactagaacaaaaggtaaatgaattaacaggaggactagaggagactttaaaagaaaaggatcaaaatgaccaaaaactagaaaaacttatggttcaaatgaaagttctctctgaagacaaagaagtattgtcagctgaagtgaagtctctttatgaggaaaacaataaactcagttcagaaaaaaaacagttgagtagggatttggaggtttttttgtctcaaaaagaagatgttatccttaaagaacatattactcaattagaaaagaaacttcagttaatggttgaagagcaagataatttaaataaactgcttgaaaatgagcaagttcagaagttatttgttaaaactcagttgtatggttttcttaaagaaatgggatcagaagtttcagaagacagtgaagagaaagatgttgttaatgtcctacaggcagtcggtgaatccttggcaaaaataaatgaggaaaaatgcaacctggcttttcagcgtgatgaaaaagtattagagttagaaaaagagattaagtgccttcaagaagagagtgtagttcagtgtgaagaacttaagtctttattgagagactatgagcaagagaaagttctcttaaggaaagagttagaagaaatacagtcagaaaaagaggccctgcagtctgatcttctagaaatgaagaatgctaatgaaaaaacaaggcttgaaaatcagaatcttttaattcaagttgaagaagtatctcaaacatgtagcaaaagtgaaatccataatgaaaaagaaaaatgttttataaaggaacatgaaaacctaaagccactactagaacaaaaagaattacgagataggagagcagagttgatactattaaaggattccttagcaaaatcaccttctgtaaaaaatgatcctctgtcttcagtaaaagagttggaagaaaaaatagaaaatctggaaaaagaatgcaaagaaaaggaggagaaaataaataagataaaattagttgccgtaaaggcaaagaaagaactagattccagcagaaaagagacccagactgtgaaggaagaacttgaatctcttcgatcagaaaaggaccagttatctgcttccatgagagatctcattcaaggagcagaaagctataagaatcttttattagaatatgaaaagcagtcagagcaactggatgtggaaaaagaacgtgctaataattttgagcatcgtattgaagaccttacaagacaattaagaaattcgactttgcagtgtgaaacaataaattctgataatgaagatctcctggctcgtattgagacattacagtctaatgccaaattattagaagtacagattttagaagtccagagagccaaagcaatggtagacaaagaattagaagctgaaaaacttcagaaagaacagaagataaaggaacatgccactactgtaaatgaacttgaagaacttcaggtacaacttcaaaaggaaaagaaacagcttcagaaaaccatgcaagaattagagctggttaaaaaggatgcccaacaaaccacattgatgaatatggaaatagctgattatgaacgtttgatgaaagaactaaatcaaaagttaactaataaaaacaacaagatagaagatttggagcaagaaataaaaattcaaaaacagaaacaagaaaccctacaagaagaaataacttcattacagtcttcagtacaacaatatgaagaaaaaaacaccaaaatcaagcaattgcttgtgaaaaccaaaaaggaactggcagattcaaagcaagcagaaactgatcacttaatacttcaagcatctttaaaaggtgagctggaggcaagccagcagcaagtagaagtctataaaatacagctggctgaaataacatcagagaagcacaaaatccacgagcacctgaaaacctctgcggaacagcaccagcgtacgctaagtgcataccagcagagagtgacagcactacaggaagagtgccgtgctgccaaggcagaacaagctactgtaacctctgaattcgagagctacaaagtccgagttcataatgttctaaaacaacagaaaaataaatctatgtctcaggctgaaactgagggcgctaaacaagaaagggaacatctggaaatgctgattgaccagctaaaaatcaaattacaagatagccaaaataacttacagattaatgtatctgaacttcaaacattgcagtctgaacatgatacactgctagaaaggcacaacaagatgctgcaggaaactgtgtccaaagaggcggaactccgggaaaaattgtgttcaatacagtcagagaacatgatgatgaaatctgaacatacacagactgtgagtcagctaacatcccagaacgaggtccttcgaaatagcttccgagatcaagtgcgacatttgcaggaagaacacagaaagacagtggagacattacagcagcagctctccaagatggaagcacagctcttccagcttaagaatgaaccgaccacaagaagcccagtttcctctcaacaatctttgaagaaccttcgagaaaggagaaacacagacctcccgcttctagacatgcacactgtaacccgggaagagggagaaggcatggagacaactgatacggagtctgtgtcttccgccagcacatacacacagtctttagagcagctgcttaactctcccgaaactaaacttgagcctccattatggcatgctgaatttaccaaagaagaattggttcagaagctcagttccaccacaaaaagtgcagatcacttaaacggcctgcttcgggaaacagaagcaaccaatgcaattcttatggagcaaattaagcttctcaaaagtgaaataagaagattggaaaggaatcaagagcgagagaagtctgcagctaacctggaatacttgaagaacgtcttgctgcagttcattttcttgaaaccaggtagtgaaagagagagacttcttcctgttataaatacgatgttgcagctcagccctgaagaaaagggaaaacttgctgcggttgctcaaggtgaggaagaaaatgcttcccgttcttctggatgggcatcctatcttcatagttggtctggacttcgataggttgatggaaggaatatttttattaaccaaatagaatctatttacaaaaatggttcacgtatattaccacaattcttttgtcaaaaagtgtgtatatatgtttgcatctacatatatttgtacatctatatgacagatgtattttaaaagtttcatcttgaagtaaaagtacaacagcttgaagtgttgatagcaggccacagccctctaactcatgtgatttcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaattgcttgaggctagtgagctgtgactcccactgcactccagctcggggaacagagcgagaccttgtctctaaaaataatagtaataaaataaaaataacgttttatgactatttattgcaaggtcagagttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactatctcaaaactcattatgttgtcagagccctagagctggctagtgtaacactgactatgagtaggtgggcccaccacttgaggtgatttcatggtgtctttccaggctcttgatagggtgtcactgcatgcaagccatgaatctgttttgagaatcctctccattttcccaaataaaaacctatcacaacagtgactatatcactcagcattggatctaaatataaaagtggtgctttcagtgtttttggcagatagtgttccataagctttccatcagaagggattttagacaccttagaggtccgtgctacatcgtcacagttcctccgaataaccttaggtggtagtgttacttgcctttgacacctctgcatatgttttaatgactagatccaaactgtgttgctctgaagttctcttaagccttcagtttatactcttaatttaattttctttctgagctggagaactggctttgcactttggttacacagaacattggtttccaattcagtttaactgaaatttgctgctgatatgttgagtttgttctttaaaaaatagctcatatatctcatctttcctcctgtcttagaagaacagacctaactagtgaatgtattaatgaaaatgcatctatttcagagctgacatgaagagtttagtttttttactttataaactgtgaatatgagtatgccagctgcatacgatgtaactaatcatatttaaatatatttcactttctctttgactttagaccttttgaagtctgtataaacttgttttgaaatatagtctctgcttacgaatgtcataacaaaataattttttgcatgataaaaaattactttgattacaaaaggcatattctttcatggtttctgcaatgagaggaagtgtaatgattattttaatatttctattaaatatgtttaa

SEQ ID NO: 287736 - DNA, 5180 bp, Homo sapiens
agcgcgacctttgacctgcagtagagcctacgtcagaggctggcgcaaacagaagtgcagcggtggcggcggctggttgcgggccggcggcgggctggcggagatggaggatcttgttcaagatggggtggcttcaccagctacccctgggaccgggaaatctaagctggaaacattgcccaaagaagacctcatcaagtttgccaagaaacagatgatgctaatacagaaagctaaatcaaggtgtacagaattggagaaagaaattgaagaactcagatcaaaacctgttactgaaggaactggtgatattattaaggcattaactgaacgtctggatgctcttcttctggaaaaagcagagactgagcaacagtgtctttctctgaaaaaggaaaatataaaaatgaagcaagaggttgaggattctgtaacaaagatgggagatgcacataaggagttggaacaatcacatataaactatgtgaaagaaattgaaaatttgaaaaatgagttgatggcagtacgttccaaatacagtgaagacaaagctaacttacaaaagcagctggaagaagcaatgaatacgcaattagaactttcagaacaacttaaatttcagaacaactctgaagataatgttaaaaaactacaagaagagattgagaaaattaggccaggctttgaggagcaaattttatatctgcaaaagcaattagacgctaccactgatgaaaagaaggaaacagttactcaactccaaaatatcattgaggctaattctcagcattaccaaaaaaatattaatagtttgcaggaagagcttttacagttgaaagctatacaccaagaagaggtgaaagagttgatgtgccagattgaagcatcagctaaggaacatgaagcagagataaataagttgaacgagctaaaagagaacttagtaaaacaatgtgaggcaagtgaaaagaacatccagaagaaatatgaatgtgagttagaaaatttaaggaaagccacctcaaatgcaaaccaagacaatcagatatgttctattctcttgcaagaaaatacatttgtagaacaagtagtaaatgaaaaagtcaaacacttagaagataccttaaaagaacttgaatctcaacacagtatcttaaaagatgaggtaacttatatgaataatcttaagttaaaacttgaaatggatgctcaacatataaaggatgagttttttcatgaacgggaagacttagagtttaaaattaatgaattattactagctaaagaagaacagggctgtgtaattgaaaaattaaaatctgagctagcaggtttaaataaacagttttgctatactgtagaacagcataacagagaagtacagagtcttaaggaacaacatcaaaaagaaatatcagaactaaatgagacatttttgtcagattcagaaaaagaaaaattaacattaatgtttgaaatacagggtcttaaggaacagtgtgaaaacctacagcaagaaaagcaagaagcaattttaaattatgagagtttacgagagattatggaaattttacaaacagaactgggggaatctgctggaaaaataagtcaagagttcgaatcaatgaagcaacagcaagcatctgatgttcatgaactgcagcagaagctcagaactgcttttactgaaaaagatgcccttctcgaaactgtgaatcgcctccagggagaaaatgaaaagttactatctcaacaagaattggtaccagaacttgaaaataccataaagaaccttcaagaaaagaatggagtatacttacttagtctcagtcaaagagataccatgttaaaagaattagaaggaaagataaattctcttactgaggaaaaagatgattttataaataaactgaaaaattcccatgaagaaatggataatttccataagaaatgtgaaagggaagaaagattgattcttgaacttgggaagaaagtagagcaaacaatccagtacaacagtgaactagaacaaaaggtaaatgaattaacaggaggactagaggagactttaaaagaaaaggatcaaaatgaccaaaaactagaaaaacttatggttcaaatgaaagttctctctgaagacaaagaagtattgtcagctgaagtgaagtctctttatgaggaaaacaataaactcagttcagaaaaaaaacagttgagtagggatttggaggtttttttgtctcaaaaagaagatgttatccttaaagaacatattactcaattagaaaagaaacttcagttaatggttgaagagcaagataatttaaataaactgcttgaaaatgagcaagttcagaagttatttgttaaaactcagttgtatggttttcttaaagaaatgggatcagaagtttcagaagacagtgaagagaaagatgttgttaatgtcctacaggcagtcggtgaatccttggcaaaaataaatgaggaaaaatgcaacctggcttttcagcgtgatgaaaaagtattagagttagaaaaagagattaagtgccttcaagaagagagtgtagttcagtgtgaagaacttaagtctttattgagagactatgagcaagagaaagttctcttaaggaaagagttagaagaaatacagtcagaaaaagaggccctgcagtctgatcttctagaaatgaagaatgctaatgaaaaaacaaggcttgaaaatcagaatcttttaattcaagttgaagaagtatctcaaacatgtagcaaaagtgaaatccataatgaaaaagaaaaatgttttataaaggaacatgaaaacctaaagccactactagaacaaaaagaattacgagataggagagcagagttgatactattaaaggattccttagcaaaatcaccttctgtaaaaaatgatcctctgtcttcagtaaaagagttggaagaaaaaatagaaaatctggaaaaagaatgcaaagaaaaggaggagaaaataaataagataaaattagttgccgtaaaggcaaagaaagaactagattccagcagaaaagagacccagactgtgaaggaagaacttgaatctcttcgatcagaaaaggaccagttatctgcttccatgagagatctcattcaaggagcagaaagctataagaatcttttattagaatatgaaaagcagtcagagcaactggatgtggaaaaagaacgtgctaataattttgagcatcgtattgaagaccttacaagacaattaagaaattcgactttgcagtgtgaaacaataaattctgataatgaagatctcctggctcgtattgagacattacagtctaatgccaaattattagaagtacagattttagaagtccagagagccaaagcaatggtagacaaagaattagaagctgaaaaacttcagaaagaacagaagataaaggaacatgccactactgtaaatgaacttgaagaacttcaggtacaacttcaaaaggaaaagaaacagcttcagaaaaccatgcaagaattagagctggttaaaaaggatgcccaacaaaccacattgatgaatatggaaatagctgattatgaacgtttgatgaaagaactaaatcaaaagttaactaataaaaacaacaagatagaagatttggagcaagaaataaaaattcaaaaacagaaacaagaaaccctacaagaagaaataacttcattacagtcttcagtacaacaatatgaagaaaaaaacaccaaaatcaagcaattgcttgtgaaaaccaaaaaggaactggcagattcaaagcaagcagaaactgatcacttaatacttcaagcatctttaaaaggtgagctggaggcaagccagcagcaagtagaagtctataaaatacagctggctgaaataacatcagagaagcacaaaatccacgagcacctgaaaacctctgcggaacagcaccagcgtacgctaagtgcataccagcagagagtgacagcactacaggaagagtgccgtgctgccaaggcagaacaagctactgtaacctctgaattcgagagctacaaagtccgagttcataatgttctaaaacaacagaaaaataaatctatgtctcaggctgaaactgagggcgctaaacaagaaagggaacatctggaaatgctgattgaccagctaaaaatcaaattacaagatagccaaaataacttacagattaatgtatctgaacttcaaacattgcagtctgaacatgatacactgctagaaaggcacaacaagatgctgcaggaaactgtgtccaaagaggcggaactccgggaaaaattgtgttcaatacagtcagagaacatgatgatgaaatctgaacatacacagactgtgagtcagctaacatcccagaacgaggtccttcgaaatagcttccgagatcaagtgcgacatttgcaggaagaacacagaaagacagtggagacattacagcagcagctctccaagatggaagcacagctcttccagcttaagaatgaaccgaccacaagaagcccagtttcctctcaacaatctttgaagaaccttcgagaaaggagaaacacagacctcccgcttctagacatgcacactgtaacccgggaagagggagaaggcatggagacaactgatacggagtctgtgtcttccgccagcacatacacacagtctttagagcagctgcttaactctcccgaaactaaacttgagcctccattatggcatgctgaatttaccaaagaagaattggttcagaagctcagttccaccacaaaaagtgcagatcacttaaacggcctgcttcgggaaacagaagcaaccaatgcaattcttatggagcaaattaagcttctcaaaagtgaaataagaagattggaaaggaatcaagagcgagagaagtctgcagctaacctggaatacttgaagaacgtcttgctgcagttcattttcttgaaaccaggtagtgaaagagagagacttcttcctgttataaatacgatgttgcagctcagccctgaagaaaagggaaaacttgctgcggttgctcaaggtgaggaagaaaatgcttcccgttcttctggatgggcatcctatcttcatagttggtctggacttccatcaacctatcgaagtccagtcgacg

SEQ ID NO: 287737 - DNA, 3532 bp, Homo sapiens
aaatatccaactcctcatttctttgttacagtgtaaacaatttcagtattacagaaaagcacccatttattgctgtggcatcattttagcaattttacaaatgaaaaaaaaaatttacaaatgaactgatctactattgtgtaaatcttttacttataaaatgtgcaggatgcccaacaaaccacattgatgaatatggaaatagctgattatgaacgtttgatgaaagaactaaatcaaaagttaactaataaaaacaacaagatagaagatttggagcaagaaataaaaattcaaaaacagaaacaagaaaccctacaagaagaaataacttcattacagtcttcagtacaacaatatgaagaaaaaaacaccaaaatcaagcaattgcttgtgaaaaccaaaaaggaactggcagattcaaagcaagcagaaactgatcacttaatacttcaagcatctttaaaaggtgagctggaggcaagccagcagcaagtagaagtctataaaatacagctggctgaaataacatcagagaagcacaaaatccacgagcacctgaaaacctctgcggaacagcaccagcgtacgctaagtgcataccagcagagagtgacagcactacaggaagagtgccgtgctgccaaggcagaacaagctactgtaacctctgaattcgagagctacaaagtccgagttcataatgttctaaaacaacagaaaaataaatctatgtctcaggctgaaactgagggcgctaaacaagaaagggaacatctggaaatgctgattgaccagctaaaaatcaaattacaagatagccaaaataacttacagattaatgtatctgaacttcaaacattgcagtctgaacatgatacactgctagaaaggcacaacaagatgctgcaggaaactgtgtccaaagaggcggaactccgggaaaaattgtgttcaatacagtcagagaacatgatgatgaaatctgaacatacacagactgtgagtcagctaacatcccagaacgaggtccttcgaaatagcttccgagatcaagtgcgacatttgcaggaagaacacagaaagacagtggagacattacagcagcagctctccaagatggaagcacagctcttccagcttaagaatgaaccgaccacaagaagcccagtttcctctcaacaatctttgaagaaccttcgagaaaggagaaacacagacctcccgcttctagacatgcacactgtaacccgggaagagggagaaggcatggagacaactgatacggagtctgtgtcttccgccagcacatacacacagtctttagagcagctgcttaactctcccgaaactaaacttgagcctccattatggcatgctgaatttaccaaagaagaattggttcagaagctcagttccaccacaaaaagtgcagatcacttaaacggcctgcttcgggaaacagaagcaaccaatgcaattcttatggagcaaattaagcttctcaaaagtgaaataagaagattggaaaggaatcaagagcgagagaagtctgcagctaacctggaatacttgaagaacgtcttgctgcagttcattttcttgaaaccaggtagtgaaagagagagacttcttcctgttataaatacgatgttgcagctcagccctgaagaaaagggaaaacttgctgcggttgctcaaggtgaggaagaaaatgcttcccgttcttctggatgggcatcctatcttcatagttggtctggacttcgataggttgatggaaggaatatttttattaaccaaatagaatctatttacaaaaatggttcacgtatattaccacaattcttttgtcaaaaagtgtgtatatatgtttgcatctacatatatttgtacatctatatgacagatgtattttaaaagtttcatcttgaagtaaaagtacaacagcttgaagtgttgatagcaggccacagccctctaactcatgtgatttcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaattgcttgaggctagtgagctgtgactcccactgcactccagctcggggaacagagcgagaccttgtctctaaaaataatagtaataaaataaaaataacgttttatgactatttattgcaaggtcagagttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactatctcaaaactcattatgttgtcagagccctagagctggctagtgtaacactgactatgagtaggtgggcccaccacttgaggtgatttcatggtgtctttccaggctcttgatagggtgtcactgcatgcaagccatgaatctgttttgagaatcctctccattttcccaaataaaaacctatcacaacagtgactatatcactcagcattggatctaaatataaaagtggtgctttcagtgtttttggcagatagtgttccataagctttccatcagaagggattttagacaccttagaggtccgtgctacatcgtcacagttcctccgaataaccttaggtggtagtgttacttgcctttgacacctctgcatatgttttaatgactagatccaaactgtgttgttcttaaatcaaaaattggataatttgtaatatttatgtgttaatcacacagtatgctctctgaagttctcttaagccttcagtttatactcttaatttaattttctttctgagctggagaactggctttgcactttggttacacagaacattggtttccaattcagtttaactgaaatttgctgctgatatgttgagtttgttctttaaaaaatagctcatatatctcatctttcctcctgtcttagaagaacagacctaactagtgaatgtattaatgaaaatgcatctatttcagagctgacatgaagagtttagtttttttactttataaactgtgaatatgagtatgccagctgcatacgatgtaactaatcatatttaaatatatttcactttctctttgactttagaccttttgaagtctgtataaacttgttttgaaatatagtctctgcttacgaatgtcataacaaaataattttttgcatgataaaaaattactttgattacaaaaggcatattctttcatggtttctgcaatgagaggaagtgtaatgattattttaatatttctattaaatatgtttaa

SEQ ID NO: 287738 - DNA, 3406 bp, Homo sapiens
ttctgagttaatttttctcaaatttataaaaagaggggatatcataagagaaaatgtttattaagttccaaaagcacatagtgtcactataaaatgtatggttagtaaattaatctaccagggtagaagacatggtagaaacagatctcttatcagaaaatatgtattattgagaggcctttaaaaagtgtaaggcctcccaacatgaagacctgataaatgttggaggcaatggatatcctaattaccctgatttgcttattagacattgtatgcatccatcaaaatatcacatgcaccccataaatatgtacaattatgtatcaattaaaaagaaaattttttaagtgtaaagccaacagaagtatgctttttagcaaggttaatcaagaaaccaaaaagaatgtcagccatttttctcattttcaaaaacaggtttttatctcaatttgttaatctctgaaagaaaatagaaggaccctgttacagtagaaaaacgtttctctcttttaaatgttataggcagaacaagctactgtaacctctgaattcgagagctacaaagtccgagttcataatgttctaaaacaacagaaaaataaatctatgtctcaggctgaaactgagggcgctaaacaagaaagggaacatctggaaatgctgattgaccagctaaaaatcaaattacaagatagccaaaataacttacagattaatgtatctgaacttcaaacattgcagtctgaacatgatacactgctagaaaggcacaacaagatgctgcaggaaactgtgtccaaagaggcggaactccgggaaaaattgtgttcaatacagtcagagaacatgatgatgaaatctgaacatacacagactgtgagtcagctaacatcccagaacgaggtccttcgaaatagcttccgagatcaagtgcgacatttgcaggaagaacacagaaagacagtggagacattacagcagcagctctccaagatggaagcacagctcttccagcttaagaatgaaccgaccacaagaagcccagtttcctctcaacaatctttgaagaaccttcgagaaaggagaaacacagacctcccgcttctagacatgcacactgtaacccgggaagagggagaaggcatggagacaactgatacggagtctgtgtcttccgccagcacatacacacagtctttagagcagctgcttaactctcccgaaactaaacttgagcctccattatggcatgctgaatttaccaaagaagaattggttcagaagctcagttccaccacaaaaagtgcagatcacttaaacggcctgcttcgggaaacagaagcaaccaatgcaattcttatggagcaaattaagcttctcaaaagtgaaataagaagattggaaaggaatcaagagcgagagaagtctgcagctaacctggaatacttgaagaacgtcttgctgcagttcattttcttgaaaccaggtagtgaaagagagagacttcttcctgttataaatacgatgttgcagctcagccctgaagaaaagggaaaacttgctgcggttgctcaaggtgaggaagaaaatgcttcccgttcttctggatgggcatcctatcttcatagttggtctggacttcgataggttgatggaaggaatatttttattaaccaaatagaatctatttacaaaaatggttcacgtatattaccacaattcttttgtcaaaaagtgtgtatatatgtttgcatctacatatatttgtacatctatatgacagatgtattttaaaagtttcatcttgaagtaaaagtacaacagcttgaagtgttgatagcaggccacagccctctaactcatgtgatttcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaattgcttgaggctagtgagctgtgactcccactgcactccagctcggggaacagagcgagaccttgtctctaaaaataatagtaataaaataaaaataacgttttatgactatttattgcaaggtcagagttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactatctcaaaactcattatgttgtcagagccctagagctggctagtgtaacactgactatgagtaggtgggcccaccacttgaggtgatttcatggtgtctttccaggctcttgatagggtgtcactgcatgcaagccatgaatctgttttgagaatcctctccattttcccaaataaaaacctatcacaacagtgactatatcactcagcattggatctaaatataaaagtggtgctttcagtgtttttggcagatagtgttccataagctttccatcagaagggattttagacaccttagaggtccgtgctacatcgtcacagttcctccgaataaccttaggtggtagtgttacttgcctttgacacctctgcatatgttttaatgactagatccaaactgtgttgttcttaaatcaaaaattggataatttgtaatatttatgtgttaatcacacagtatgctctctgaagttctcttaagccttcagtttatactcttaatttaattttctttctgagctggagaactggctttgcactttggttacacagaacattggtttccaattcagtttaactgaaatttgctgctgatatgttgagtttgttctttaaaaaatagctcatatatctcatctttcctcctgtcttagaagaacagacctaactagtgaatgtattaatgaaaatgcatctatttcagagctgacatgaagagtttagtttttttactttataaactgtgaatatgagtatgccagctgcatacgatgtaactaatcatatttaaatatatttcactttctctttgactttagaccttttgaagtctgtataaacttgttttgaaatatagtctctgcttacgaatgtcataacaaaataattttttgcatgataaaaaattactttgattacaaaaggcatattctttcatggtttctgcaatgagaggaagtgtaatgattattttaatatttctattaaatatgtttaa

SEQ ID NO: 287739 - DNA, 3530 bp, Homo sapiens
agcgcgacctttgacctgcagtagagcctacgtcagaggctggcgcaaacagaagtgcagcggtggcggcggctggttgcgggccggcggcgggctggcggagatggaggatcttgttcaagatggggtggcttcaccagctacccctgggaccgggaaatctaagctggaaacattgcccaaagaagacctcatcaagtttgccaagaaacagatgatgctaatacagaaagctaaatcaaggtgtacagaattggagaaagaaattgaagaactcagatcaaaacctgttactgaaggaactggtgatattattaaggcattaactgaacgtctggatgctcttcttctggaaaaagcagagactgagcaacagtgtctttctctgaaaaaggaaaatataaaaatgaagcaagaggttgaggattctgtaacaaagatgggagatgcacataaggagttggaacaatcacatataaactatgtgaaagaaattgaaaatttgaaaaatgagttgatggcagtacgttccaaatacagtgaagacaaagctaacttacaaaagcagctggaagaagcaatgaatacgcaattagaactttcagaacaacttaaatttcagaacaactctgaagataatgttaaaaaactacaagaagagattgagaaaattaggccaggctttgaggagcaaattttatatctgcaaaagcaattagacgctaccactgatgaaaagaaggaaacagttactcaactccaaaatatcattgaggctaattctcagcattaccaaaaaaatattaatagtttgcaggaagagcttttacagttgaaagctatacaccaagaagaggtgaaagagttgatgtgccagattgaagcatcagctaaggaacatgaagcagagataaataagttgaacgagctaaaagagaacttagtaaaacaatgtgaggcaagtgaaaagaacatccagaagaaatatgaatgtgagttagaaaatttaaggaaagccacctcaaatgcaaaccaagacaatcagatatgttctattctcttgcaagaaaatacatttgtagaacaagtagtaaatgaaaaagtcaaacacttagaagataccttaaaagaacttgaatctcaacacagtatcttaaaagatgaggtaacttatatgaataatcttaagttaaaacttgaaatggatgctcaacatataaaggatgagttttttcatgaacgggaagacttagagtttaaaattaatgaattattactagctaaagaagaacagggctgtgtaattgaaaaattaaaatctgagctagcaggtttaaataaacagttttgctatactgtagaacagcataacagagaagtacagagtcttaaggaacaacatcaaaaagaaatatcagaactaaatgagacatttttgtcagattcagaaaaagaaaaattaacattaatgtttgaaatacagggtcttaaggaacagtgtgaaaacctacagcaagaaaagcaagaagcaattttaaattatgagagtttacgagagattatggaaattttacaaacagaactgggggaatctgctggaaaaataagtcaagagttcgaatcaatgaagcaacagcaagcatctgatgttcatgaactgcagcagaagctcagaactgcttttactgaaaaagatgcccttctcgaaactgtgaatcgcctccagggagaaaatgaaaagttactatctcaacaagaattggtaccagaacttgaaaataccataaagaaccttcaagaaaagaatggagtatacttacttagtctcagtcaaagagataccatgttaaaagaattagaaggaaagataaattctcttactgaggaaaaagatgattttataaataaactgaaaaattcccatgaagaaatggataatttccataagaaatgtgaaagggaagaaagattgattcttgaacttgggaagaaagtagagcaaacaatccagtacaacagtgaactagaacaaaaggtaaatgaattaacaggaggactagaggagactttaaaagaaaaggatcaaaatgaccaaaaactagaaaaacttatggttcaaatgaaagttctctctgaagacaaagaagtattgtcagctgaagtgaagtctctttatgaggaaaacaataaactcagttcagaaaaaaaacagttgagtagggatttggaggtttttttgtctcaaaaagaagatgttatccttaaagaacatattactcaattagaaaagaaacttcagttaatggttgaagagcaagataatttaaataaactgcttgaaaatgagcaagttcagaagttatttgttaaaactcagttgtatggttttcttaaagaaatgggatcagaagtttcagaagacagtgaagagaaagatgttgttaatgtcctacaggcagtcggtgaatccttggcaaaaataaatgaggaaaaatgcaacctggcttttcagcgtgatgaaaaagtattagagttagaaaaagagattaagtgccttcaagaagagagtgtagttcagtgtgaagaacttaagtctttattgagagactatgagcaagagaaagttctcttaaggaaagagttagaagaaatacagtcagaaaaagaggccctgcagtctgatcttctagaaatgaagaatgctaatgaaaaaacaaggcttgaaaatcagaatcttttaattcaagttgaagaagtatctcaaacatgtagcaaaagtgaaatccataatgaaaaagaaaaatgttttataaaggaacatgaaaacctaaagccactactagaacaaaaagaattacgagataggagagcagagttgatactattaaaggattccttagcaaaatcaccttctgtaaaaaatgatcctctgtcttcagtaaaagagttggaagaaaaaataggtaactatggttttgcagatgttgtcacaattaattagacagattcttgttagtgttagaatagattgggaaatatagtagccaaataatgagttgttaaaaacacagttcgtagctgtcttttcctcgagctcacattcttgcccctctaacacctgtttgccttctctttcaaaagtgttactttctattgtttaacccaagcaagattggtgtgatttataaatggcttcatgatttattttggatttttcattcatttagcaaattttatttaaatgcccaactattctagaccctggtgatagaaaagtggttgaggtacagaccatgtgctcagagatctcactgttgtttgaggtgtggacaagatacagtactaacagcataggaacttaacactgttttgagttaaaaaaaaaaaaaaaagcagcgtagaatagggttttcagccaagtcttgaagaatgagaaattttacacaggaagaaaggtattctaggaagaaggaagagcaggtgcttgtaggttgacatatagcatacatcaaggcacgtactaggaagtt

SEQ ID NO: 287740 - DNA, 3572 bp, Homo sapiens
agcgcgacctttgacctgcagtagagcctacgtcagaggctggcgcaaacagaagtgcagcggtggcggcggctggttgcgggccggcggcgggctggcggagatggaggatcttgttcaagatggggtggcttcaccagctacccctgggaccgggaaatctaagctggaaacattgcccaaagaagacctcatcaagtttgccaagaaacagatgatgctaatacagaaagctaaatcaaggtgtacagaattggagaaagaaattgaagaactcagatcaaaacctgttactgaaggaactggtgatattattaaggcattaactgaacgtctggatgctcttcttctggaaaaagcagagactgagcaacagtgtctttctctgaaaaaggaaaatataaaaatgaagcaagaggttgaggattctgtaacaaagatgggagatgcacataaggagttggaacaatcacatataaactatgtgaaagaaattgaaaatttgaaaaatgagttgatggcagtacgttccaaatacagtgaagacaaagctaacttacaaaagcagctggaagaagcaatgaatacgcaattagaactttcagaacaacttaaatttcagaacaactctgaagataatgttaaaaaactacaagaagagattgagaaaattaggccaggctttgaggagcaaattttatatctgcaaaagcaattagacgctaccactgatgaaaagaaggaaacagttactcaactccaaaatatcattgaggctaattctcagcattaccaaaaaaatattaatagtttgcaggaagagcttttacagttgaaagctatacaccaagaagaggtgaaagagttgatgtgccagattgaagcatcagctaaggaacatgaagcagagataaataagttgaacgagctaaaagagaacttagtaaaacaatgtgaggcaagtgaaaagaacatccagaagaaatatgaatgtgagttagaaaatttaaggaaagccacctcaaatgcaaaccaagacaatcagatatgttctattctcttgcaagaaaatacatttgtagaacaagtagtaaatgaaaaagtcaaacacttagaagataccttaaaagaacttgaatctcaacacagtatcttaaaagatgaggtaacttatatgaataatcttaagttaaaacttgaaatggatgctcaacatataaaggatgagttttttcatgaacgggaagacttagagtttaaaattaatgaattattactagctaaagaagaacagggctgtgtaattgaaaaattaaaatctgagctagcaggtttaaataaacagttttgctatactgtagaacagcataacagagaagtacagagtcttaaggaacaacatcaaaaagaaatatcagaactaaatgagacatttttgtcagattcagaaaaagaaaaattaacattaatgtttgaaatacagggtcttaaggaacagtgtgaaaacctacagcaagaaaagcaagaagcaattttaaattatgagagtttacgagagattatggaaattttacaaacagaactgggggaatctgctggaaaaataagtcaagagttcgaatcaatgaagcaacagcaagcatctgatgttcatgaactgcagcagaagctcagaactgcttttactgaaaaagatgcccttctcgaaactgtgaatcgcctccagggagaaaatgaaaagttactatctcaacaagaattggtaccagaacttgaaaataccataaagaaccttcaagaaaagaatggagtatacttacttagtctcagtcaaagagataccatgttaaaagaattagaaggaaagataaattctcttactgaggaaaaagatgattttataaataaactgaaaaattcccatgaagaaatggataatttccataagaaatgtgaaagggaagaaagattgattcttgaacttgggaagaaagtagagcaaacaatccagtacaacagtgaactagaacaaaaggtaaatgaattaacaggaggactagaggagactttaaaagaaaaggatcaaaatgaccaaaaactagaaaaacttatggttcaaatgaaagttctctctgaagacaaagaagtattgtcagctgaagtgaagtctctttatgaggaaaacaataaactcagttcagaaaaaaaacagttgagtagggatttggaggtttttttgtctcaaaaagaagatgttatccttaaagaacatattactcaattagaaaagaaacttcagttaatggttgaagagcaagataatttaaataaactgcttgaaaatgagcaagttcagaagttatttgttaaaactcagttgtatggttttcttaaagaaatgggatcagaagtttcagaagacagtgaagagaaagatgttgttaatgtcctacaggcagtcggtgaatccttggcaaaaataaatgaggaaaaatgcaacctggcttttcagcgtgatgaaaaagtattagagttagaaaaagagattaagtgccttcaagaagagagtgtagttcagtgtgaagaacttaagtctttattgagagactatgagcaagagaaagttctcttaaggaaagagttagaagaaatacagtcagaaaaagaggccctgcagtctgatcttctagaaatgaagaatgctaatgaaaaaacaaggcttgaaaatcagaatcttttaattcaagttgaagaagtatctcaaacatgtagcaaaagtgaaatccataatgaaaaagaaaaatgttttataaaggaacatgaaaacctaaagccactactagaacaaaaagaattacgagataggagagcagagttgatactattaaaggattccttagcaaaatcaccttctgtaaaaaatgatcctctgtcttcagtaaaagagttggaagaaaaaataggaaaaaatcgactagaaaggggaaaattattgctgcagaagaaggagggagaattgttgctctgatgcttgagtaggtaatgagacgcaggatgaaatgcagatgtggaacaattggcctttgctccgcacacagacacttcactatggcagccagagggaaggcaccggtgcaagtaaattaataggccaggacagaaattcagatcataactgaatttttagaaacaaataccaagaagtcctgaactcaggagttcaagctaaagaagttaacagagatcaatattggataggtaaaacatattacaggtttcgttgtgaaaatcagacccagcagccaagaggaggagtgcacttatggagcataaatgttgatctgcatctgatatctctgatacttgatcctaatttgcacactatcacctaaagtcctagcatacctgcatttccaggaaatctaatgagaaagaagtcctgaaagcctctaattcctggaaacatatgaaacggctagaaaaaagtagactattttggaggattaaagacaatggaaactttttacattgtttgtctcacataatgaataaaattccactttaaaaaatga

SEQ ID NO: 287741 - DNA, 115 bp, Homo sapiens
ccaccattttttaaccccaggcaaataaatcttgttctaaaataggcattaactgaacgtctggatgctcttcttctggaaaaagcagagactgagcaacagtgtctttctctga

SEQ ID NO: 287742 - DNA, 419 bp, Homo sapiens
gacatttgcaggaagaacacagaaagacagtggagacattacagcagcagctctccaagatggaagcacagctcttccagcttaagaatgaaccgaccacaagaagtatgtatgtacacatggaaatattagttgttcatgttttcatgcatttgtctcttaaatacattcttcacaaattcataagaaagaaaatttactaggtgtcaccagtgtcaaatctgtgattaatgaattttggatttgcttactagaaagataattgaaccatctgaatccttccctcttcattatacttacagaagtctgtataacctctgagaatgctgactttgatgtattccttaccctcaatggaaaggagtatttctttttctctgacttaaacatcctctgtcagtctcgtgacatgtcttttt

SEQ ID NO: 287743 - DNA, 472 bp, Homo sapiens
acatcagagaagcacaaaatccacgagcacctgaaaacctctgcggaacagcaccagcgtacgctaagtgcataccagcagagagtgacagcactacaggaagagtgccgtgctgccaaggtgcgttcttcagggcagccacagcaagccactgggattttattatcagctagtcattggtttactccagggctgtgctctgcctttttagtattttcctgttaagagcacttactagattaagacctgttcagttaatctggctttaaccccaatcccatgccaaccctaatcgtaagttggatcactttttttgccaaaaggaaaaacatgatgttttttccatttcaaccttgttttgcaatttatgtgtcacttatttataaaactttttttattagaaacgtgttacagttcttagggctaaatgattataaaataacattttaatagcatggctgtgggggcctac

SEQ ID NO: 287744 - DNA, 353 bp, Homo sapiens
tttgaattgatgttggtttaagaaaagataacttagaaaatgttctacttgtctctgctttttcaataataatacataaaaatatttcactacttaattatgccttatatgtacttatgtctcaaacctaaagtttgtattttaaggaaaacctctttaactagtgaagataggatttgctaaagctaaatttaaagatttacccccagatacagctggctgaaataacatcagagaagcacaaaatccacgagcacctgaaaacctctgcggaacagcaccagcgtacgctaagtgcataccagcagagagtgacagcactacaggaagagtgccgtgctgccaaggtgcgt

SEQ ID NO: 287745 - DNA, 164 bp, Homo sapiens
gatttatggggggttttgtgagaatgtacttatcagtttcccagtaattatgttctttatttctgaaccggagtcctttattttttaattgtttagaattggagaaagaaattgaagaactcagatcaaaacctgttactgaaggaactggtgatattattaag

SEQ ID NO: 287746 - DNA, 356 bp, Homo sapiens
aggggacacattcaaaccatattacccagtctcactggatgaatgctatctaagatgagctggacactgtcacaacacttggtgcgtggtcatttcttttccttgaaattatgatgcactatcttcagtctgtaagcaccatagtctcaggtcctttgggataagatatggtgtcttttgaaagggaggaggttgagcctggatacattggctttgggccttctgcctgtcctctctaatacatacttggtgttgggtgtggttttccttttggggtaatttggattattgccactcaaagtgtggtccatgtactaacggcatggaagaatctcaggcccaagacccactgaatg

SEQ ID NO: 287747 - DNA, 1890 bp, Homo sapiens
agcggagtgtttctctcctacagaggatgcagtgtccaggcatcatctatgaatggagacaacctttaccggacaccaaacctaccagcaccatgaccttgaactttccagccttctgaactatggcgtactgctctgttgcccaggttagagtgcagtggcttgatcatagctcactgcagccttgagctcctaggctcaagcagtcctcttgcctcagcctcctgaatagctgggactacaggttctattctgaggtactaaggttaagacctcaacatatgaattctggaggacaaaattcaacccagaagtctaccttgtattgggtcctcacggcaaggctgcaaaacccggggggttggtggcccagtcccacctcccatgagctaatgaatgtggggctcagggaggactgacaggactagagttgacaaccattcatccaacaaacatttactgcacgaggaagagaggtgatcaaggcactgcccttgtccccaggaagctcgccagtgcatgggactgtgcaggtgtcttcacctctgcattaggcattcgatgtcaggccatggctgagcatccatcctctctatgctaattttttccaaaagtcaagagtttggaagaacactaatgtgtttttcttccagcctttcctatacaaatgacaacatcattaccctcagcttttaaagtgcaagtctgtacagagatcccagagtcaaggagggcgcctgagtcatttgaaataattacctttttttttcctgcctgagtcttgcatatctgtgaatcagcaatgtggaaactgggcttcaaaaaaattaagggaggcttaaagtgagcaaagcagagaagagcattggcaagagctgagcgctgccacagcaggaacatcatgccgatcgtcatctaagggagctcatggtgctgtctgcctcctcttagcaacatccacacaggctggtacagtcagatcattgtgacttggacagggatgaaaatactcagctgacaccaatagctcccagcacagccagggtattctagagttgtgtggttcaagacagccctgtgcagcctcattgtatttacctgagtcacctgaacaaagcggtgactggctttgcctggctctggcaaggactcgcaacaaagccaaagcctcttcctccacggcctttgctcctgcagcacagcactggcatctttttagcatcatagacactgtcacgtggcaatcaatgacagatgaactgtcccttccctgggccacaagctcttcaaggcgggagcctcagcccagtttcttccatgtctccagcgcccagcacagggcctggcttctagctggtttctgatgaataaacgaatggctatagagatgtactcttcaaaacacaaggggcttctatagtggcaacatgttcagtagcacagtgctgtattggttctttacagcttgcaggacccaaagaaggaatgatttttgtttcccgggaaaggtgtacctcgtgggggcactgctcaagggaaggtgcccacaagttggggatcaagggaggcacaggttgatcaaagcccctggaattgaaatggaggtgttcacctgcggaggctccgaacatctgaggcagagcctcgattctccaggaaattgactttgccggagaacaaggctggggaaggcaggctgtcctaggggaggagtcgtatttcagccccactgagaccccaaaggcgcactcccatgctttaccccagctgtccaccagggggcaggcagaggcaagagaagaggaaagcgggcggctggtcaggcccagcacatccagcctggcatcccacacgctgggctgcctgactcagacaaagccaggccgctcc

SEQ ID NO: 287748 - DNA, 1333 bp, Homo sapiens
ggggtctgcggtgggcggtgtttcgtcgcgacagactctaggaaatttcacgatagaactagctttaggcgcttgagccttgccgtctttttggggtgtggcctgtctccgtctgccaaaggctttgagcttcctggtgttcatcgtacctccgcttggtcctgtcgtgactaaaccacgacagcaggaaaaaaaaaaaagcagctagccaagttgctgaggaattacggtgtgcagagccctcgcagctccttctcttgggaactcctggtctggttaggttctcagcgaggaaacagcctcccaccccgcccgattccgcctaattaactcaagggccagctccttttgctggcctccctgcttccacggagcagttaggcccgcctaaactcagcgagcgtttctggagcaccttgaggatagggaccaagtaacagagtccgggtgttaaggttatgatagtagttaacgttttcggaaagagactgtgtcaggctctgtgctaagaactttacatgaagtatttattcttcatgactgtgagctcctctaggacactgaaaaagcatcctaacatgctcaggacaggataggaaatggtcctctggcttgaaagactcagcatccagaagtagtacctcactctccatccagtggtcaccccccagaaatgtgctctcgccctacccacctgcctgggagctgcctgcctcttgatgtgctgacacctgctcctgctgctgctgctgctgctgctgctgttgctgctgctgctgctgttgccgttctctcaagggctggcggaactgagcagcccccaggacaacattccggagcttggcccagcgcagacgcccacctggtgtgccagacggccacttgctttccaacacagcctaccaagcacagtgcccatcaggatggcctacctcgacaccctaaccctgcctcatacccactccctgtcttggagccccagggaccgcccttcccctgcagacatcctgtctaggactgtccggccaatggctcagccaggaacaagagcccagaagagacagtaggcagcagctgcctcccaaggggcctagaagaacccagaggcagtggagaaaatttgtacccagaccttgctgcttagaaatataaaatatatggctctgaagaaatcatttcatttatttggtcattagtctcctcatctaaaaaacaggaggcagtttagtatcatggctggtgccgatgaatagcgaggtgcggatgaatagcgaggtgccgatgaatagcgagtgccgatgatagcgaggtgccgatgatagcaggagtcctc

SEQ ID NO: 287749 - DNA, 1023 bp, Homo sapiens
ggggtctgcggtgggcggtgtttcgtcgcgacagactctaggaaatttcacgatagaactagctttaggcgcttgagccttgccgtctttttggggtgtggcctgtctccgtctgccaaaggctttgagcttcctggtgttcatcgtacctccgcttggtcctgtcgtgactaaaccacgacagcaggaaaaaaaaaaaagcagctagccaagttgctgaggaattacggtgtgcagagccctcgcagctccttctcttgggaactcctggtctggttaggttctcagcgaggaaacagcctcccaccccgcccgattccgcctaattaactcaagggccagctccttttgctggcctccctgcttccacggagcagttaggcccgcctaaactcagcgagcgtttctggagcaccttgaggatagggaccaagtaacagagtccgggtgttaaggttatgatagtagttaacgttttcggaaagagactgtgtcaggctctgtgctaagaactttacatgaagtatttattcttcatgactgtgagctcctctaggacactgaaaaagcatcctaacatgctcaggacaggataggaaatggtcctctggcttgaaagactcagcatccagaagtagtacctcatacccactccctgtcttggagccccagggaccgcccttcccctgcagacatcctgtctaggactgtccggccaatggctcagccaggaacaagagcccagaagagacagtaggcagcagctgcctcccaaggggcctagaagaacccagaggcagtggagaaaatttgtacccagaccttgctgcttagaaatataaaatatatggctctgaagaaatcatttcatttatttggtcattagtctcctcatctaaaaaacaggaggcagtttagtatcatggctggtgccgatgaatagcgaggtgcggatgaatagcgaggtgccgatgaatagcgagtgccgatgatagcgaggtgccgatgatagcaggagtcctc

SEQ ID NO: 287750 - DNA, 488 bp, Homo sapiens
tgggactacaggtgcgcgccaccacgcccagctaatttttttatcccttttgttaccagtcaagtgtaatttatcaatccccagaaacccaatgccaaccattagaccagccccaactctctatgcctttccctgcctgagcccagctactccatccccaagcctgtctcaccaggccctacccacctgcctgggagctgcctgcctcttgatgtgctgacacctgctcctgctgctgctgctgctgctgctgctgttgctgctgctgctgctgttgccgttctctcaagggctggcggaactgagcagcccccaggacaacattccggagcttggcccagcgcagacgcccacctggtgtgccagacggccacttgctttccaacacagcctaccaagcacagtgcccatcaggatggcctacctcgacaccctaaccctgcctcatacccactccctgtcttggagccccagggaccgcccttccc

SEQ ID NO: 287751 - DNA, 1166 bp, Homo sapiens
  misc_feature (5)..(5): n is a, c, g, or t
  misc_feature (39)..(39): n is a, c, g, or t
  misc_feature (264)..(264): n is a, c, g, or t
  misc_feature (285)..(285): n is a, c, g, or t
ttcgntctagaggatccctcaacgcttatacttcctagntctagatgactacttttggactttatggttgtttttcttccttaaaaaccacttctccttacacagtacaattctttttaacttggggctttaaattttcggttaaggatagagaatgacacagaagcaccaaaataagattaatgaagatgagaatgatttcatatttgagtacatttaactgaagatctagacatgtctttaaagaaggtccaaagaaaattngcaacccaaataaaggctttnggtattagcagaacaccaccatcctttgattcaataaacatctaatatgcaccttccatgtaaaagatactaagaacaagaaacactaaaatgaaagacactttccctactctcaaggaaaacaggctagtagaaaacgcagactcaagagtgaagatatggaaaataaaataagtgataccaagaagaagcaggggatgaagaagaggagcaacagtgaagtggaagacgtgggaccaacaagtcataacagaaagaaggccaggtgggacactttagagcctttggataccggcctgtctttagcagaggatgaagagctggtgttacatctgctaagaagtcaaagctaaatacttcctgcgcctgccttctccttgaaaccttggttatgactgcgtaggcaagaagttgaaaaacagttgatttgggggcacttaggtaccatatgccccattcccaaagggcacatttctggatagaagcgatcgtatctccaagtccctctcacaggacatgctttgtgccatcactgagcatactcagatcgagggtggatgataccatttcctgaccccgttttccagcatgtgttctgttagatttttatccatgggttcctacgccttgtcattggaaacactgcctttgtcttactggcaagttctggagctcttgtgtcattgttagaaatccctgtcttgcttactgtacagaagtttctgttgctgttaaaattgctcatgatttcgacgtatttaatattttcaaagagactatgatggaccagccctgagaaagaatgagtatttttgaattgagatgatcaataataaacatatttcctataaaagaaagtattaatgtttgcattgtgtcca

SEQ ID NO: 287752 - DNA, 1215 bp, Homo sapiens
ccccgggaaggaaacacatcggctaggtacgaggctgggtggtgcagcatcaagaaaaaaatgaccaaagttgcagaagcaaaaaaagtaatgaagagaaattttaaagtgaataagaagataacatttactgatgaaggggagttggttcagcagtggccacaaatgcagaaatctgccatcaaggatgctgaggaagatgatgacacaggtggtatcaacttacataaagcaaaggaaagacttcaggaagaggacaaatttgacaaagaagaatataggaaaaaaattaaggcaaagcatcgggagaaaagactgaaagaaagggaagccagaagagaagccaacaagagacaagcaaaggccaaagatgaagaggaagcctttctggattggagtgatgatgatgatgatgatgatgatggatttgatccaagcacactcccagatccagataaatacagaagctctgaagattcagatagtgaagatatggaaaataaaataagtgataccaagaagaagcaggggatgaagaagaggagcaacagtgaagtggaagacgtgggaccaacaagtcataacagaaagaaggccaggtgggacactttagagcctttggataccggcctgtctttagcagaggatgaagagctggtgttacatctgctaagaagtcaaagctaaatacttcctgcgcctgccttctccttgaaaccttggttatgactgcgtaggcaagaagttgaaaaacagttgatttgggggcacttaggtaccatatgccccattcccaaagggcacatttctggatagaagcgatcgtatctccaagtccctctcacaggacatgctttgtgccatcactgagcatactcagatcgagggtggatgataccatttcctgaccccgttttccagcatgtgttctgttagatttttatccatgggttcctacgccttgtcattggaaacactgcctttgtcttactggcaagttctggagctcttgtgtcattgttagaaatccctgtcttgcttactgtacagaagtttctgttgctgttaaaattgctcatgatttcgacgtatttaatattttcaaagagactatgatggaccagccctgagaaagaatgagtatttttgaattgagatgatcaataataaacatatttcctataaaagaaagtattaatgtttgcattgtgtcca

SEQ ID NO: 287753 - DNA, 1497 bp, Homo sapiens
  misc_feature (21)..(21): n is a, c, g, or t
  misc_feature (25)..(25): n is a, c, g, or t
ggcacgagggtccaccctggngtantggaaaaagactcgaagggacagagcacagacaggataatgatactggtaatgaagaacaggagagaagaagaagacgatgaagaagaaatggaagagaaactggcaaaagcaaaaggatctcaagccccatctcttcctaacaccagtgaggcacagaagatcaaggaagttcctacacagttcttggacagagatgaggaggaagaggatgctgatttcttgaaggtgaagcggcataatgtgtttggattggaccttaaagacgagaaaacattacagaagaaagaaccttctaaatccagcatcaagaaaaaaatgaccaaagttgcagaagcaaaaaaagtaatgaagagaaattttaaagtgaataagaagataacatttactgatgaaggggagttggttcagcagtggccacaaatgcagaaatctgccatcaaggatgctgaggaagatgatgacacaggtggtatcaacttacataaagcaaaggaaagacttcaggaagaggacaaatttgacaaagaagaatataggaaaaaaattaaggcaaagcatcgggagaaaagactgaaagaaagggaagccagaagagaagccaacaagagacaagcaaaggccaaagatgaagaggaagcctttctggattggagtgatgatgatgatgatgatgatgatggatttgatccaagcacactcccagatccagataaatacagaagctctgaagattcagatagtgaagatatggaaaataaaataagtgataccaagaagaagcaggggatgaagaagaggagcaacagtgaagtggaagacgtgggaccaacaagtcataacagaaagaaggccaggtgggacactttagagcctttggataccggcctgtctttagcagaggatgaagagctggtgttacatctgctaagaagtcaaagctaaatacttcctgcgcctgccttctccttgaaaccttggttatgactgcgtaggcaagaagttgaaaaacagttgatttgggggcacttaggtaccatatgccccattcccaaagggcacatttctggatagaagcgatcgtatctccaagtccctctcacaggacatgctttgtgccatcactgagcatactcagatcgagggtggatgataccatttcctgaccccgttttccagcatgtgttctgttagatttttatccatgggttcctacgccttgtcattggaaacactgcctttgtcttactggcaagttctggagctcttgtgtcattgttagaaatccctgtcttgcttactgtacagaagtttctgttgctgttaaaattgctcatgatttcgacgtatttaatattttcaaagagactatgatggaccagccctgagaaagaatgagtatttttgaattgagatgatcaataataaacatatttcctataaaagaaagtattaatgtttgcattgtgtcca

SEQ ID NO: 287754 - DNA, 1434 bp, Homo sapiens
  misc_feature (1311)..(1311): n is a, c, g, or t
  misc_feature (1402)..(1402): n is a, c, g, or t
  misc_feature (1421)..(1421): n is a, c, g, or t
  misc_feature (1429)..(1429): n is a, c, g, or t
ccccgggaaggaaacacatcggctaggtacgaggctgggtggtgcagcatcaagaaaaaaatgaccaaagttgcagaagcaaaaaaagtaatgaagagaaattttaaagtgaataagaagataacatttactgatgaaggggagttggttcagcagtggccacaaatgcagaaatctgccatcaaggatgctgaggaagatgatgacacaggtggtatcaacttacataaagcaaaggaaagacttcaggaagaggacaaatttgacaaagaagaatataggaaaaaaattaaggcaaagcatcgggagaaaagactgaaagaaagggaagccagaagagaagccaacaagagacaagcaaaggccaaagatgaagaggaagcctttctggattggagtgatgatgatgatgatgatgatgatggatttgatccaagcacactcccagatccagataaatacagaagctctgaagattcagatagtgaagatatggaaaataaaataagtgataccaagaagaagcaggggatgaagaagaggagcaacagtgaagtggaagacgtgggaccaacaagtcataacagaaagaaggccaggtgggacactttagagcctttggataccggcctgtctttagcagaggatgaagagctggtgttacatctgctaagaagtcaaagctaaatacttcctgcgcctgccttctccttgaaaccttggttatgactgcgtaggcaagaagttgaaaaacagttgatttgggggcacttaggtaccatatgccccattcccaaagggcacatttctggatagaagcgatcgtatctccaagtccctctcacaggacatgctttgtgccatcactgagcatactcagatcgagggtggatgataccatttcctgaccccgttttccagcatgtgttctgttagatttttatccatgggttcctacgccttgtcattggaaacactgcctttgtcttactggcaagttctggagctcttgtgtcattgttagaaatccctgtcttgcttactgtacagaagtttctgttgctgttaaaattgctcatgatttcgacgtatttaatattttcaaagagactatgataacacaggcccaagatgatcttgggcctgtgttatccgaactagtctcaggcttcaacatcgaatacgccgcaggccccttcgccctattcttcatagccgaatacacaaacattattataataaacaccctcaccactacaatcttcctaggaacaacatatgacgcactctcccctgaactctacacaacanattttgtcaccaagaccctacttctaacctccctgttcttatgaattcgaacagcatacccccgataacacaggccggagatgaggggatnatctagagtgggccttcangaaggganttcaa

SEQ ID NO: 287755 - DNA, 937 bp, Homo sapiens
gaaaggagactcaaagtttaggtagaagggcattctgggtgcaaggaacattatcagtatggctggatgattgaagaccatgaaggccaaagatgaagaggaagcctttctggattggagtgatgatgatgatgatgatgatgatggatttgatccaagcacactcccagatccagataaatacagaagctctgaagattcagatagtgaagatatggaaaataaaataagtgataccaagaagaagcaggggatgaagaagaggagcaacagtgaagtggaagacgtgggaccaacaagtcataacagaaagaaggccaggtgggacactttagagcctttggataccggcctgtctttagcagaggatgaagagctggtgttacatctgctaagaagtcaaagctaaatacttcctgcgcctgccttctccttgaaaccttggttatgactgcgtaggcaagaagttgaaaaacagttgatttgggggcacttaggtaccatatgccccattcccaaagggcacatttctggatagaagcgatcgtatctccaagtccctctcacaggacatgctttgtgccatcactgagcatactcagatcgagggtggatgataccatttcctgaccccgttttccagcatgtgttctgttagatttttatccatgggttcctacgccttgtcattggaaacactgcctttgtcttactggcaagttctggagctcttgtgtcattgttagaaatccctgtcttgcttactgtacagaagtttctgttgctgttaaaattgctcatgatttcgacgtatttaatattttcaaagagactatgatggaccagccctgagaaagaatgagtatttttgaattgagatgatcaataataaacatatttcctataaaagaaagtattaatgtttgcattgtgtcca

SEQ ID NO: 287756 - DNA, 2752 bp, Homo sapiens
ccacttctgagcattttacagttcagtgtacttaactgtaaaggtatacaggctcaagtcgttgcatattcttcctgttttgatagaaattgcagggatttatgtactgaatcttattactccttagatatgtgacaactggaaagctccccaccaaaccctccagccttggttacttcttaatgatgtggtttggcacaatgaaaatgtcataggctttgtggtgaaactgacttctgcctccactcctgccaacacttattattagcctcttaagtccccgagcctgtttcagaggtaatctcacacaaaggctagagaattaaaaaacatgtagagagcctggcactaatacctacctcccccaccagcagctcttaattatgagatcaaccactattattttagaccagagttttgttggggattgggtttgtttcagaaggcactattttaaataagatgtgtagcttctatttagatatttgcctttaaagtcagctgagctattttcctattgtttgcaaatttacttttatttaaaaaaataaaatttcctaaagcagtgtttccccaatatgacagtcatcagaaaaaaccacctagagttttctaaacatagattccagtgattgtaaatcagaatctgagagtgggactagaaaatacttaattctatcctgtggtacaagctggtctcacacttgcatctttgcacctaagactagatcaaactggtactaatcctctggccccagcatcccatccttggggaaatagtctagtttagaggtagtcctggactggagcgctaagtccagcattcctcacctgcataacactacccacatgatcatatgtcccctgggctctcaagctgataggaaaaagtcgtcttgctaaatgaaatcccccaacctcttggtaatgtgaagaactgtactgcaaagctttgaagcaatcctatgttaggcatgcgggtgggaacggggccagacagagggaaaaaatggaatagaatgatccgagagtaaataattcttgctttattatgaaccaagtcacattttgtctcttccaacagatgcttgagccaaaaaagcaaacataggcagaaatacaattgagaatatcttcatgtttcaacctttaatctgacttgccttttactatcctttccccatttcttctaatctcttttgccttacaatatattaccttctaggtatcacctcatcctatagaatcccttctagtttaatgtcctgccccaaacaatactaacccattgaagataactatgaaacctttaaatggacagtggttccttttaaaagcagccttactgaaaattttatatacacttaaatcaagtaacagttaccgtgagttttctaaacttttgtgttaacagaaatgccagttcagcagtgtgactgttacttttaaatgtctgtcttgccgccctagagtgacagacatcccagttaaacatattaggaataagaaatacataaatccaatgaagactgtagaaaaagaattttagcacttgaaggaacttcagtcatttaacccaacccattcatgttatagattgagaccatagaaataaaagtagcctataggatacaaaagttagcggcagatctgagataaaaatccagctctttggatccccgcgtttttcaccacacttagctgtcgttcccatgtattacgaacaaagaatcaaatataatcaagtgcagcctcacttcacaggcaagaaaacagactagagtttaatatattgcccatgtttatcttaaggtgaaacatttactcttacaaccacagttgatgttaacctagttaataaaatatgaaaggtaattactaggggaattttaaacggcactacataagcaaacatgactcaaattactttttccatttctgcttcccaaattattggagttactgaagcaagctatgctgctttcaattccaatgataggcatattcccaaataaactcatttaaagagctcataaaatgaattatcctatttccaagtcagttgattagcaaattaagatacagctccaagttaccctactgcttaagggttttccggtccaatttgtaaggttttcggatttaaagattcagactgcataccaaaggtggacaaagacaacgcaagctgatttaggttgtcacgtggcacatactctagtttaaaccctcaactacaagaaaagaaatggtgtattgtcatttttgccaaagcaccccaaaatgaaatactttcttactcaatctaggttcttttttttcattctagtcccttaagctcctaggatttttagatgttgaaaatactccctgcgcccggcattcaatattgtatggttcattaggatctgttgtggctggctttggacattttttgttcactagtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtca

SEQ ID NO: 287757 - DNA, 928 bp, Homo sapiens
  misc_feature (608)..(608): n is a, c, g, or t
tcacttatgtctaggtcgaggcctgggtgttatttcgatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaaaaaaaaaaaaaaaggggggggggggggcggaaaaaaaccccgggggggggggaaagagacgtaccacccaccaatcattttaagaaaaaagcggcgccaaacaaggagggcaaataataaaagagagcacggccgagcgataaaacacggcgaggggagagcacagcctcgagtggagctgtagggaacaccacctcgtcgggggggaaaacagaggagacccaccacaagagaaaacgcgcgaggacaaacaacacgcgggtggagggcagcccagcctctggcgagaaagctgccagaatgaaaaaaataag

SEQ ID NO: 287758 - DNA, 1107 bp, Homo sapiens
  misc_feature (168)..(168): n is a, c, g, or t
  misc_feature (787)..(787): n is a, c, g, or t
agttgttgccttcccttttgggccccccgggtttttccttttatcttcgcggttggtattttgtgtaaattggaagggaatacatttccacaaaggacaaatgttatccattgtttccccaaggctaaattttacccttcttaaagggaacaaaagggggagctcccnccgggtgggcgcccggttatagaaaaagtgtatcccccgggctcaagaatttcgccaaaaggcgaattagtcttcatgccggccccgccgaagccgggtaagccaaagaaaagaaagtcccttaagctcctaggatttttagatgttgaaaatactccctgcgcccggcattcaatattgtatggttcattaggatctgttgtggctggctttggacattttttgttcactagtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcaaaaaaaaaaaaaaaaaaaaaaaaaaaaaaaaaaaaaaaaaaaaaaaaaaaaaaaaaaaaaaaaaaaaaaaaaaaaaaanaaaaaaaaaaaaaaaaaaaggggggggggggggcggaaaaaaaccccgggggggggggaaagagacgtaccacccaccaatcattttaagaaaaaagcggcgccaaacaaggagggcaaataataaaagagagcacggccgagcgataaaacacggcgaggggagagcacagcctcgagtggagctgtagggaacaccacctcgtcgggggggaaaacagaggagacccaccacaagagaaaacgcgcgaggacaaacaacacgcgggtggagggcagcccagcctctggcgagaaagctgccagaatgaaaaaaataag

SEQ ID NO: 287759 - DNA, 810 bp, Homo sapiens
  misc_feature (490)..(490): n is a, c, g, or t
ggccgaagtggagaagggttccatgtgaacttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttacaaaaaaaaaaaaaaaaaaaaaaaaaaaaaaaaaaaaaaaaaaaaaaaaaaaaaaaaaaaaaaaaaaaaaaaaaaaaaanaaaaaaaaaaaaaaaaaaaggggggggggggggcggaaaaaaaccccgggggggggggaaagagacgtaccacccaccaatcattttaagaaaaaagcggcgccaaacaaggagggcaaataataaaagagagcacggccgagcgataaaacacggcgaggggagagcacagcctcgagtggagctgtagggaacaccacctcgtcgggggggaaaacagaggagacccaccacaagagaaaacgcgcgaggacaaacaacacgcgggtggagggcagcccagcctctggcgagaaagctgccagaatgaaaaaaataag

SEQ ID NO: 287760 - DNA, 303 bp, Homo sapiens
gcggccgctccaatatcagaatcctcgtgccgcctcgtgccgaattcggcacgagtgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattaaaata

SEQ ID NO: 287761 - DNA, 262 bp, Homo sapiens
ctgcggaggcagaagcaggaagcaggtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatacgcagggtttgtaggggcagaagcagtacgg

SEQ ID NO: 287762 - DNA, 5397 bp, Homo sapiens
ccacttctgagcattttacagttcagtgtacttaactgtaaaggtatacaggctcaagtcgttgcatattcttcctgttttgatagaaattgcagggatttatgtactgaatcttattactccttagatatgtgacaactggaaagctccccaccaaaccctccagccttggttacttcttaatgatgtggtttggcacaatgaaaatgtcataggctttgtggtgaaactgacttctgcctccactcctgccaacacttattattagcctcttaagtccccgagcctgtttcagaggtaatctcacacaaaggctagagaattaaaaaacatgtagagagcctggcactaatacctacctcccccaccagcagctcttaattatgagatcaaccactattattttagaccagagttttgttggggattgggtttgtttcagaaggcactattttaaataagatgtgtagcttctatttagatatttgcctttaaagtcagctgagctattttcctattgtttgcaaatttacttttatttaaaaaaataaaatttcctaaagcagtgtttccccaatatgacagtcatcagaaaaaaccacctagagttttctaaacatagattccagtgattgtaaatcagaatctgagagtgggactagaaaatacttaattctatcctgtggtacaagctggtctcacacttgcatctttgcacctaagactagatcaaactggtactaatcctctggccccagcatcccatccttggggaaatagtctagtttagaggtagtcctggactggagcgctaagtccagcattcctcacctgcataacactacccacatgatcatatgtcccctgggctctcaagctgataggaaaaagtcgtcttgctaaatgaaatcccccaacctcttggtaatgtgaagaactgtactgcaaagctttgaagcaatcctatgttaggcatgcgggtgggaacggggccagacagagggaaaaaatggaatagaatgatccgagagtaaataattcttgctttattatgaaccaagtcacattttgtctcttccaacagatgcttgagccaaaaaagcaaacataggcagaaatacaattgagaatatcttcatgtttcaacctttaatctgacttgccttttactatcctttccccatttcttctaatctcttttgccttacaatatattaccttctaggtatcacctcatcctatagaatcccttctagtttaatgtcctgccccaaacaatactaacccattgaagataactatgaaacctttaaatggacagtggttccttttaaaagcagccttactgaaaattttatatacacttaaatcaagtaacagttaccgtgagttttctaaacttttgtgttaacagaaatgccagttcagcagtgtgactgttacttttaaatgtctgtcttgccgccctagagtgacagacatcccagttaaacatattaggaataagaaatacataaatccaatgaagactgtagaaaaagaattttagcacttgaaggaacttcagtcatttaacccaacccattcatgttatagattgagaccatagaaataaaagtagcctataggatacaaaagttagcggcagatctgagataaaaatccagctctttggatccccgcgtttttcaccacacttagctgtcgttcccatgtattacgaacaaagaatcaaatataatcaagtgcagcctcacttcacaggcaagaaaacagactagagtttaatatattgcccatgtttatcttaaggtgaaacatttactcttacaaccacagttgatgttaacctagttaataaaatatgaaaggtaattactaggggaattttaaacggcactacataagcaaacatgactcaaattactttttccatttctgcttcccaaattattggagttactgaagcaagctatgctgctttcaattccaatgataggcatattcccaaataaactcatttaaagagctcataaaatgaattatcctatttccaagtcagttgattagcaaattaagatacagctccaagttaccctactgcttaagggttttccggtccaatttgtaaggttttcggatttaaagattcagactgcataccaaaggtggacaaagacaacgcaagctgatttaggttgtcacgtggcacatactctagtttaaaccctcaactacaagaaaagaaatggtgtattgtcatttttgccaaagcaccccaaaatgaaatactttcttactcaatctaggttcttttttttcattctagtcccttaagctcctaggatttttagatgttgaaaatactccctgcgcccggcattcaatattgtatggttcattaggatctgttgtggctggctttggacattttttgttcactagtgagtatctgtattttttatttctctatgtactaaaaaaagcatttctctacataatgaactatttttttttctaggtggagtaatgtatataacgtaattatattctaattaattgttatgcttatttttacaggtagaattagaagatcatgtgatgttggagtaggagggtttatcttggtgactttgggatgctggtatgtttgctaagtattcaagaacatccatgattatagtaggttatctaattcaaaaagcacatgctcttttcagagcagtctcccattgggagatcctcaccctcaatgaagaatcttgatttttcaggacattttcatggaaatcttaaaatgcttgaacagataaatgcatattagacatcccattaaaaagaaagctgtggtttttacacttcacttaggaaagcctcaaccatttcccttaccctaatacttatttcatccctgcttattcatatctgaaaatgctactttaagaatgtgtttacaactactgatgagtgaatataaaatatggatgaacctcaaatatttgccagacctaagagtatgatatgtatgtactatatggttatgtagacatagcattattatcccgttaaaaacgagagcaaatacttgtttcttataatagccaatgctatcagaagacttaaaaactaatggattttatcactttacaaattgttatgtagacatcctttttttcctaataaaaaaagaatgtgttgataggtattctgacaccaaaactgcccaaaaatagcactataaattagaacatatttttcagtctcagggtagtagtcatctgtatttaagttttgtgtgatttagagaaatttcataaattaatttctgtaggactttatattaacaatttattcatattcttttcttctaaggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattaaaata

SEQ ID NO: 287763 - DNA, 5451 bp, Homo sapiens
ccacttctgagcattttacagttcagtgtacttaactgtaaaggtatacaggctcaagtcgttgcatattcttcctgttttgatagaaattgcagggatttatgtactgaatcttattactccttagatatgtgacaactggaaagctccccaccaaaccctccagccttggttacttcttaatgatgtggtttggcacaatgaaaatgtcataggctttgtggtgaaactgacttctgcctccactcctgccaacacttattattagcctcttaagtccccgagcctgtttcagaggtaatctcacacaaaggctagagaattaaaaaacatgtagagagcctggcactaatacctacctcccccaccagcagctcttaattatgagatcaaccactattattttagaccagagttttgttggggattgggtttgtttcagaaggcactattttaaataagatgtgtagcttctatttagatatttgcctttaaagtcagctgagctattttcctattgtttgcaaatttacttttatttaaaaaaataaaatttcctaaagcagtgtttccccaatatgacagtcatcagaaaaaaccacctagagttttctaaacatagattccagtgattgtaaatcagaatctgagagtgggactagaaaatacttaattctatcctgtggtacaagctggtctcacacttgcatctttgcacctaagactagatcaaactggtactaatcctctggccccagcatcccatccttggggaaatagtctagtttagaggtagtcctggactggagcgctaagtccagcattcctcacctgcataacactacccacatgatcatatgtcccctgggctctcaagctgataggaaaaagtcgtcttgctaaatgaaatcccccaacctcttggtaatgtgaagaactgtactgcaaagctttgaagcaatcctatgttaggcatgcgggtgggaacggggccagacagagggaaaaaatggaatagaatgatccgagagtaaataattcttgctttattatgaaccaagtcacattttgtctcttccaacagatgcttgagccaaaaaagcaaacataggcagaaatacaattgagaatatcttcatgtttcaacctttaatctgacttgccttttactatcctttccccatttcttctaatctcttttgccttacaatatattaccttctaggtatcacctcatcctatagaatcccttctagtttaatgtcctgccccaaacaatactaacccattgaagataactatgaaacctttaaatggacagtggttccttttaaaagcagccttactgaaaattttatatacacttaaatcaagtaacagttaccgtgagttttctaaacttttgtgttaacagaaatgccagttcagcagtgtgactgttacttttaaatgtctgtcttgccgccctagagtgacagacatcccagttaaacatattaggaataagaaatacataaatccaatgaagactgtagaaaaagaattttagcacttgaaggaacttcagtcatttaacccaacccattcatgttatagattgagaccatagaaataaaagtagcctataggatacaaaagttagcggcagatctgagataaaaatccagctctttggatccccgcgtttttcaccacacttagctgtcgttcccatgtattacgaacaaagaatcaaatataatcaagtgcagcctcacttcacaggcaagaaaacagactagagtttaatatattgcccatgtttatcttaaggtgaaacatttactcttacaaccacagttgatgttaacctagttaataaaatatgaaaggtaattactaggggaattttaaacggcactacataagcaaacatgactcaaattactttttccatttctgcttcccaaattattggagttactgaagcaagctatgctgctttcaattccaatgataggcatattcccaaataaactcatttaaagagctcataaaatgaattatcctatttccaagtcagttgattagcaaattaagatacagctccaagttaccctactgcttaagggttttccggtccaatttgtaaggttttcggatttaaagattcagactgcataccaaaggtggacaaagacaacgcaagctgatttaggttgtcacgtggcacatactctagtttaaaccctcaactacaagaaaagaaatggtgtattgtcatttttgccaaagcaccccaaaatgaaatactttcttactcaatctaggttcttttttttcattctagtcccttaagctcctaggatttttagatgttgaaaatactccctgcgcccggcattcaatattgtatggttcattaggatctgttgtggctggctttggacattttttgttcactagtgagtatctgtattttttatttctctatgtactaaaaaaagcatttctctacataatgaactatttttttttctaggtggagtaatgtatataacgtaattatattctaattaattgttatgcttatttttacaggtagaattagaagatcatgtgatgttggagtaggagggtttatcttggtgactttgggatgctggtatgtttgctaagtattcaagaacatccatgattatagtaggttatctaattcaaaaagcacatgctcttttcagagcagtctcccattgggagatcctcaccctcaatgaagaatcttgatttttcaggacattttcatggaaatcttaaaatgcttgaacagataaatgcatattagacatcccattaaaaagaaagctgtggtttttacacttcacttaggaaagcctcaaccatttcccttaccctaatacttatttcatccctgcttattcatatctgaaaatgctactttaagaatgtgtttacaactactgatgagtgaatataaaatatggatgaacctcaaatatttgccagacctaagagtatgatatgtatgtactatatggttccatttatacatgaatttctacagtgagctatttaaggtggtagaaatcatgttatgtagacatagcattattatcccgttaaaaacgagagcaaatacttgtttcttataatagccaatgctatcagaagacttaaaaactaatggattttatcactttacaaattgttatgtagacatcctttttttcctaataaaaaaagaatgtgttgataggtattctgacaccaaaactgcccaaaaatagcactataaattagaacatatttttcagtctcagggtagtagtcatctgtatttaagttttgtgtgatttagagaaatttcataaattaatttctgtaggactttatattaacaatttattcatattcttttcttctaaggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattaaaata

SEQ ID NO: 287764 - DNA, 2640 bp, Homo sapiens
cgcgccggagacggttagaaatggcggttggggcggagcagggggctggcgcgggaagcggggctgtctggctcggttacgcccccacctcgccaggaatctaggagtcggtttgttttccgaacccatctccttccgctctcccgcccctgcaggctgtgtgccgagcttggaagaaagtgtgacccgttcgacggaacaaaggacatgacagcccggccccgtgcggccactgcggagcgttaggaacattccctaaaatggcggccggcgcgtcggaacagggcgggaggcggcggcgcgtgggggcgggacggggaggggcgcggccagccgggcttctgcttccgcgaccccggcggtgcagggcgggtggagtcgcggagtagtcctcatggccgccccgccggagcccggtgagcccgaggagaggaagtcccttaagctcctaggatttttagatgttgaaaatactccctgcgcccggcattcaatattgtatggttcattaggatctgttgtggctggctttggacattttttgttcactagtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattaaaata

SEQ ID NO: 287765 - DNA, 2609 bp, Homo sapiens
gctggtaccggccggagatttatggatcggggctgtctggctcggttacgcccccacctcgccaggaatctaggagtcggtttgttttccgaacccatctccttccgctctcccgcccctgcaggctgtgtgccgagcttggaagaaagtgtgacccgttcgacggaacaaaggacatgacagcccggccccgtgcggccactgcggagcgttaggaacattccctaaaatggcggccggcgcgtcggaacagggcgggaggcggcggcgcgtgggggcgggacggggaggggcgcggccagccgggcttctgcttccgcgaccccggcggtgcagggcgggtggagtcgcggagtagtcctcatggccgccccgccggagcccggtgagcccgaggagaggaagtcccttaagctcctaggatttttagatgttgaaaatactccctgcgcccggcattcaatattgtatggttcattaggatctgttgtggctggctttggacattttttgttcactagtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattaaaata

SEQ ID NO: 287766 - DNA, 4533 bp, Homo sapiens
ccacttctgagcattttacagttcagtgtacttaactgtaaaggtatacaggctcaagtcgttgcatattcttcctgttttgatagaaattgcagggatttatgtactgaatcttattactccttagatatgtgacaactggaaagctccccaccaaaccctccagccttggttacttcttaatgatgtggtttggcacaatgaaaatgtcataggctttgtggtgaaactgacttctgcctccactcctgccaacacttattattagcctcttaagtccccgagcctgtttcagaggtaatctcacacaaaggctagagaattaaaaaacatgtagagagcctggcactaatacctacctcccccaccagcagctcttaattatgagatcaaccactattattttagaccagagttttgttggggattgggtttgtttcagaaggcactattttaaataagatgtgtagcttctatttagatatttgcctttaaagtcagctgagctattttcctattgtttgcaaatttacttttatttaaaaaaataaaatttcctaaagcagtgtttccccaatatgacagtcatcagaaaaaaccacctagagttttctaaacatagattccagtgattgtaaatcagaatctgagagtgggactagaaaatacttaattctatcctgtggtacaagctggtctcacacttgcatctttgcacctaagactagatcaaactggtactaatcctctggccccagcatcccatccttggggaaatagtctagtttagaggtagtcctggactggagcgctaagtccagcattcctcacctgcataacactacccacatgatcatatgtcccctgggctctcaagctgataggaaaaagtcgtcttgctaaatgaaatcccccaacctcttggtaatgtgaagaactgtactgcaaagctttgaagcaatcctatgttaggcatgcgggtgggaacggggccagacagagggaaaaaatggaatagaatgatccgagagtaaataattcttgctttattatgaaccaagtcacattttgtctcttccaacagatgcttgagccaaaaaagcaaacataggcagaaatacaattgagaatatcttcatgtttcaacctttaatctgacttgccttttactatcctttccccatttcttctaatctcttttgccttacaatatattaccttctaggtatcacctcatcctatagaatcccttctagtttaatgtcctgccccaaacaatactaacccattgaagataactatgaaacctttaaatggacagtggttccttttaaaagcagccttactgaaaattttatatacacttaaatcaagtaacagttaccgtgagttttctaaacttttgtgttaacagaaatgccagttcagcagtgtgactgttacttttaaatgtctgtcttgccgccctagagtgacagacatcccagttaaacatattaggaataagaaatacataaatccaatgaagactgtagaaaaagaattttagcacttgaaggaacttcagtcatttaacccaacccattcatgttatagattgagaccatagaaataaaagtagcctataggatacaaaagttagcggcagatctgagataaaaatccagctctttggatccccgcgtttttcaccacacttagctgtcgttcccatgtattacgaacaaagaatcaaatataatcaagtgcagcctcacttcacaggcaagaaaacagactagagtttaatatattgcccatgtttatcttaaggtgaaacatttactcttacaaccacagttgatgttaacctagttaataaaatatgaaaggtaattactaggggaattttaaacggcactacataagcaaacatgactcaaattactttttccatttctgcttcccaaattattggagttactgaagcaagctatgctgctttcaattccaatgataggcatattcccaaataaactcatttaaagagctcataaaatgaattatcctatttccaagtcagttgattagcaaattaagatacagctccaagttaccctactgcttaagggttttccggtccaatttgtaaggttttcggatttaaagattcagactgcataccaaaggtggacaaagacaacgcaagctgatttaggttgtcacgtggcacatactctagtttaaaccctcaactacaagaaaagaaatggtgtattgtcatttttgccaaagcaccccaaaatgaaatactttcttactcaatctaggttcttttttttcattctagtcccttaagctcctaggatttttagatgttgaaaatactccctgcgcccggcattcaatattgtatggttcattaggatctgttgtggctggctttggacattttttgttcactagtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattaaaata

SEQ ID NO: 287767 - DNA, 5264 bp, Homo sapiens
ccacttctgagcattttacagttcagtgtacttaactgtaaaggtatacaggctcaagtcgttgcatattcttcctgttttgatagaaattgcagggatttatgtactgaatcttattactccttagatatgtgacaactggaaagctccccaccaaaccctccagccttggttacttcttaatgatgtggtttggcacaatgaaaatgtcataggctttgtggtgaaactgacttctgcctccactcctgccaacacttattattagcctcttaagtccccgagcctgtttcagaggtaatctcacacaaaggctagagaattaaaaaacatgtagagagcctggcactaatacctacctcccccaccagcagctcttaattatgagatcaaccactattattttagaccagagttttgttggggattgggtttgtttcagaaggcactattttaaataagatgtgtagcttctatttagatatttgcctttaaagtcagctgagctattttcctattgtttgcaaatttacttttatttaaaaaaataaaatttcctaaagcagtgtttccccaatatgacagtcatcagaaaaaaccacctagagttttctaaacatagattccagtgattgtaaatcagaatctgagagtgggactagaaaatacttaattctatcctgtggtacaagctggtctcacacttgcatctttgcacctaagactagatcaaactggtactaatcctctggccccagcatcccatccttggggaaatagtctagtttagaggtagtcctggactggagcgctaagtccagcattcctcacctgcataacactacccacatgatcatatgtcccctgggctctcaagctgataggaaaaagtcgtcttgctaaatgaaatcccccaacctcttggtaatgtgaagaactgtactgcaaagctttgaagcaatcctatgttaggcatgcgggtgggaacggggccagacagagggaaaaaatggaatagaatgatccgagagtaaataattcttgctttattatgaaccaagtcacattttgtctcttccaacagatgcttgagccaaaaaagcaaacataggcagaaatacaattgagaatatcttcatgtttcaacctttaatctgacttgccttttactatcctttccccatttcttctaatctcttttgccttacaatatattaccttctaggtatcacctcatcctatagaatcccttctagtttaatgtcctgccccaaacaatactaacccattgaagataactatgaaacctttaaatggacagtggttccttttaaaagcagccttactgaaaattttatatacacttaaatcaagtaacagttaccgtgagttttctaaacttttgtgttaacagaaatgccagttcagcagtgtgactgttacttttaaatgtctgtcttgccgccctagagtgacagacatcccagttaaacatattaggaataagaaatacataaatccaatgaagactgtagaaaaagaattttagcacttgaaggaacttcagtcatttaacccaacccattcatgttatagattgagaccatagaaataaaagtagcctataggatacaaaagttagcggcagatctgagataaaaatccagctctttggatccccgcgtttttcaccacacttagctgtcgttcccatgtattacgaacaaagaatcaaatataatcaagtgcagcctcacttcacaggcaagaaaacagactagagtttaatatattgcccatgtttatcttaaggtgaaacatttactcttacaaccacagttgatgttaacctagttaataaaatatgaaaggtaattactaggggaattttaaacggcactacataagcaaacatgactcaaattactttttccatttctgcttcccaaattattggagttactgaagcaagctatgctgctttcaattccaatgataggcatattcccaaataaactcatttaaagagctcataaaatgaattatcctatttccaagtcagttgattagcaaattaagatacagctccaagttaccctactgcttaagggttttccggtccaatttgtaaggttttcggatttaaagattcagactgcataccaaaggtggacaaagacaacgcaagctgatttaggttgtcacgtggcacatactctagtttaaaccctcaactacaagaaaagaaatggtgtattgtcatttttgccaaagcaccccaaaatgaaatactttcttactcaatctaggttcttttttttcattctagtcccttaagctcctaggatttttagatgttgaaaatactccctgcgcccggcattcaatattgtatggttcattaggatctgttgtggctggctttggacattttttgttcactagtgagtatctgtattttttatttctctatgtactaaaaaaagcatttctctacataatgaactatttttttttctaggtggagtaatgtatataacgtaattatattctaattaattgttatgcttatttttacaggtagaattagaagatcatgtgatgttggagtaggagggtttatcttggtgactttgggatgctggtatgtttgctaagtattcaagaacatccatgattatagtaggttatctaattcaaaaagcacatgctcttttcagagcagtctcccattgggagatcctcaccctcaatgaagaatcttgatttttcaggacattttcatggaaatcttaaaatgcttgaacagataaatgcatattagacatcccattaaaaagaaagctgtggtttttacacttcacttaggaaagcctcaaccatttcccttaccctaatacttatttcatccctgcttattcatatctgaaaatgctactttaagaatgtgtttacaactactgatgagtgaatataaaatatggatgaacctcaaatatttgccagacctaagagtatgatatgtatgtactatatggttatgtagacatagcattattatcccgttaaaaacgagagcaaatacttgtttcttataatagccaatgctatcagaagacttaaaaactaatggattttatcactttacaaattgttatgtagacatcctttttttcctaataaaaaaagaatgtgttgataggtattctgacaccaaaactgcccaaaaatagcactataaattagaacatatttttcagtctcagggtagtagtcatctgtatttaagttttgtgtgatttagagaaatttcataaattaatttctgtaggactttatattaacaatttattcatattcttttcttctaaggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcagtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattaaaata

SEQ ID NO: 287768 - DNA, 4381 bp, Homo sapiens
  misc_feature (7)..(8): n is a, c, g, or t
  misc_feature (15)..(15): n is a, c, g, or t
  misc_feature (19)..(19): n is a, c, g, or t
  misc_feature (41)..(42): n is a, c, g, or t
  misc_feature (44)..(44): n is a, c, g, or t
  misc_feature (59)..(59): n is a, c, g, or t
aggcggnncgggggngganaatgattgcttgactggacccnncnttgagttgagaatcntggcctgggggaagaaagggaggcgatattatgaacttttttatattttgtctcttccaacagatgcttgagccaaaaaagcaaacataggcagaaatacaattgagaatatcttcatgtttcaacctttaatctgacttgccttttactatcctttccccatttatagaatcccttctagtttaatgtcctgccccaaacaatactaacccattgaagataactatgaaacctttaaatggacagtggttccttttaaaagcagccttactgaaaattttatatacacttaaatcaagtaacagttaccgtgagttttctaaacttttgtgttaacagaaatgccagttcagcagtgtgactgttacttttaaatgtctgtcttgccgccctagagtgacagacatcccagttaaacatattaggaataagaaatacataaatccaatgaagactgtagaaaaagaattttagcacttgaaggaacttcagtcatttaacccaacccattcatgttatagattgagaccatagaaataaaagtagcctataggatacaaaagttagcggcagatctgagataaaaatccagctctttggatccccgcgtttttcaccacacttagctgtcgttcccatgtattacgaacaaagaatcaaatataatcaagtgcagcctcacttcacaggcaagaaaacagactagagtttaatatattgcccatgtttatcttaaggtgaaacatttactcttacaaccacagttgatgttaacctagttaataaaatatgaaaggtaattactaggggaattttaaacggcactacataagcaaacatgactcaaattactttttccatttctgcttcccaaattattggagttactgaagcaagctatgctgctttcaattccaatgataggcatattcccaaataaactcatttaaagagctcataaaatgaattatcctatttccaagtcagttgattagcaaattaagatacagctccaagttaccctactgcttaagggttttccggtccaatttgtaaggttttcggatttaaagattcagactgcataccaaaggtggacaaagacaacgcaagctgatttaggttgtcacgtggcacatactctagtttaaaccctcaactacaagaaaagaaatggtgtattgtcatttttgccaaagcaccccaaaatgaaatactttcttactcaatctaggttcttttttttcattctagtcccttaagctcctaggatttttagatgttgaaaatactccctgcgcccggcattcaatattgtatggttcattaggatctgttgtggctggctttggacattttttgttcactagtgagtatctgtattttttatttctctatgtactaaaaaaagcatttctctacataatgaactatttttttttctaggtggagtaatgtatataacgtaattatattctaattaattgttatgcttatttttacaggtagaattagaagatcatgtgatgttggagtaggagggtttatcttggtgactttgggatgctggtatgtttgctaagtattcaagaacatccatgattatagtaggttatctaattcaaaaagcacatgctcttttcagagcagtctcccattgggagatcctcaccctcaatgaagaatcttgatttttcaggacattttcatggaaatcttaaaatgcttgaacagataaatgcatattagacatcccattaaaaagaaagctgtggtttttacacttcacttaggaaagcctcaaccatttcccttaccctaatacttatttcatccctgcttattcatatctgaaaatgctactttaagaatgtgtttacaactactgatgagtgaatataaaatatggatgaacctcaaatatttgccagacctaagagtatgatatgtatgtactatatggttatgtagacatagcattattatcccgttaaaaacgagagcaaatacttgtttcttataatagccaatgctatcagaagacttaaaaactaatggattttatcactttacaaattgttatgtagacatcctttttttcctaataaaaaaagaatgtgttgataggtattctgacaccaaaactgcccaaaaatagcactataaattagaacatatttttcagtctcagggtagtagtcatctgtatttaagttttgtgtgatttagagaaatttcataaattaatttctgtaggactttatattaacaatttattcatattcttttcttctaaggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattaaaata

SEQ ID NO: 287769 - DNA, 2369 bp, Homo sapiens
tgattgcatttagacacactacttcataaacagccccaccaagaaaagaaaaatcgcgatcccgatataaaccattctaggtctaaatgcaatcatgattgcatttagacgggagtagtcctcatggccgccccgccggagcccggtgagcccgaggagaggaagtcccttaagctcctaggatttttagatgttgaaaatactccctgcgcccggcattcaatattgtatggttcattaggatctgttgtggctggctttggacattttttgttcactagtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattaaaata

SEQ ID NO: 287770 - DNA, 2494 bp, Homo sapiens
gctggtaccggccggagatttatggatcggggctgtctggctcggttacgcccccacctcgccaggaatctaggagtcggtttgttttccgaacccatctccttccgctctcccgcccctgcaggctgtgtgccgagcttggaagaaagtgtgacccgttcgacggaacaaaggacatgacagcccggccccgtgcggccactgcggagcgttaggaacattccctaaaatggcggccggcgcgtcggaacagggcgggaggcggcggcgcgtgggggcgggacggggaggggcgcggccagccgggcttctgcttccgcgaccccggcggtgcagggcgggtggagtcgcggagtagtcctcatggccgccccgccggagcccggtgagcccgaggagaggaaggtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattaaaata

SEQ ID NO: 287771 - DNA, 3359 bp, Homo sapiens
atccctcctttccatcaaatcaattggccaccaatggtactggacctacgagtacaccgactacggcggactaatcttcaactcctacatacttccccccttattcctagaaccaaggcgacctgtgactcgtggaaatgtccacgtggacatttccacgttgtcacgtggcacatactctagtttaaaccctcaactacaagaaaagaaatggtgtattgtcatttttgccaaagcaccccaaaatgaaatactttcttactcaatctaggttcttttttttcattctagtcccttaagctcctaggatttttagatgttgaaaatactccctgcgcccggcattcaatattgtatggttcattaggatctgttgtggctggctttggacattttttgttcactagtgagtatctgtattttttatttctctatgtactaaaaaaagcatttctctacataatgaactatttttttttctaggtggagtaatgtatataacgtaattatattctaattaattgttatgcttatttttacaggtagaattagaagatcatgtgatgttggagtaggagggtttatcttggtgactttgggatgctggtatgtttgctaagtattcaagaacatccatgattatagtaggttatctaattcaaaaagcacatgctcttttcagagcagtctcccattgggagatcctcaccctcaatgaagaatcttgatttttcaggacattttcatggaaatcttaaaatgcttgaacagataaatgcatattagacatcccattaaaaagaaagctgtggtttttacacttcacttaggaaagcctcaaccatttcccttaccctaatacttatttcatccctgcttattcatatctgaaaatgctactttaagaatgtgtttacaactactgatgagtgaatataaaatatggatgaacctcaaatatttgccagacctaagagtatgatatgtatgtactatatggttatgtagacatagcattattatcccgttaaaaacgagagcaaatacttgtttcttataatagccaatgctatcagaagacttaaaaactaatggattttatcactttacaaattgttatgtagacatcctttttttcctaataaaaaaagaatgtgttgataggtattctgacaccaaaactgcccaaaaatagcactataaattagaacatatttttcagtctcagggtagtagtcatctgtatttaagttttgtgtgatttagagaaatttcataaattaatttctgtaggactttatattaacaatttattcatattcttttcttctaaggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattaaaata

SEQ ID NO: 287772 - DNA, 4015 bp, Homo sapiens
  misc_feature (3695)..(3695): n is a, c, g, or t
ccacttctgagcattttacagttcagtgtacttaactgtaaaggtatacaggctcaagtcgttgcatattcttcctgttttgatagaaattgcagggatttatgtactgaatcttattactccttagatatgtgacaactggaaagctccccaccaaaccctccagccttggttacttcttaatgatgtggtttggcacaatgaaaatgtcataggctttgtggtgaaactgacttctgcctccactcctgccaacacttattattagcctcttaagtccccgagcctgtttcagaggtaatctcacacaaaggctagagaattaaaaaacatgtagagagcctggcactaatacctacctcccccaccagcagctcttaattatgagatcaaccactattattttagaccagagttttgttggggattgggtttgtttcagaaggcactattttaaataagatgtgtagcttctatttagatatttgcctttaaagtcagctgagctattttcctattgtttgcaaatttacttttatttaaaaaaataaaatttcctaaagcagtgtttccccaatatgacagtcatcagaaaaaaccacctagagttttctaaacatagattccagtgattgtaaatcagaatctgagagtgggactagaaaatacttaattctatcctgtggtacaagctggtctcacacttgcatctttgcacctaagactagatcaaactggtactaatcctctggccccagcatcccatccttggggaaatagtctagtttagaggtagtcctggactggagcgctaagtccagcattcctcacctgcataacactacccacatgatcatatgtcccctgggctctcaagctgataggaaaaagtcgtcttgctaaatgaaatcccccaacctcttggtaatgtgaagaactgtactgcaaagctttgaagcaatcctatgttaggcatgcgggtgggaacggggccagacagagggaaaaaatggaatagaatgatccgagagtaaataattcttgctttattatgaaccaagtcacattttgtctcttccaacagatgcttgagccaaaaaagcaaacataggcagaaatacaattgagaatatcttcatgtttcaacctttaatctgacttgccttttactatcctttccccatttcttctaatctcttttgccttacaatatattaccttctaggtatcacctcatcctatagaatcccttctagtttaatgtcctgccccaaacaatactaacccattgaagataactatgaaacctttaaatggacagtggttccttttaaaagcagccttactgaaaattttatatacacttaaatcaagtaacagttaccgtgagttttctaaacttttgtgttaacagaaatgccagttcagcagtgtgactgttacttttaaatgtctgtcttgccgccctagagtgacagacatcccagttaaacatattaggaataagaaatacataaatccaatgaagactgtagaaaaagaattttagcacttgaaggaacttcagtcatttaacccaacccattcatgttatagattgagaccatagaaataaaagtagcctataggatacaaaagttagcggcagatctgagataaaaatccagctctttggatccccgcgtttttcaccacacttagctgtcgttcccatgtattacgaacaaagaatcaaatataatcaagtgcagcctcacttcacaggcaagaaaacagactagagtttaatatattgcccatgtttatcttaaggtgaaacatttactcttacaaccacagttgatgttaacctagttaataaaatatgaaaggtaattactaggggaattttaaacggcactacataagcaaacatgactcaaattactttttccatttctgcttcccaaattattggagttactgaagcaagctatgctgctttcaattccaatgataggcatattcccaaataaactcatttaaagagctcataaaatgaattatcctatttccaagtcagttgattagcaaattaagatacagctccaagttaccctactgcttaagggttttccggtccaatttgtaaggttttcggatttaaagattcagactgcataccaaaggtggacaaagacaacgcaagctgatttaggttgtcacgtggcacatactctagtttaaaccctcaactacaagaaaagaaatggtgtattgtcatttttgccaaagcaccccaaaatgaaatactttcttactcaatctaggttcttttttttcattctagtcccttaagctcctaggatttttagatgttgaaaatactccctgcgcccggcattcaatattgtatggttcattaggatctgttgtggctggctttggacattttttgttcactagtgagtatctgtattttttatttctctatgtactaaaaaaagcatttctctacataatgaactatttttttttctaggtggagtaatgtatataacgtaattatattctaattaattgttatgcttatttttacaggtagaattagaagatcatgtgatgttggagtaggagggtttatcttggtgactttgggatgctggtatgtttgctaagtattcaagaacatccatgattatagtaggttatctaattcaaaaagcacatgctcttttcagagcagtctcccattgggagatcctcaccctcaatgaagaatcttgatttttcaggacattttcatggaaatcttaaaatgcttgaacagataaatgcatattagacatcccattaaaaagaaagctgtggtttttacacttcacttaggaaagcctcaaccatttcccttaccctaatacttatttcatccctgcttattcatatctgaaaatgctactttaagaatgtgtttacaactactgatgagtgaatataaaatatggatgaacctcaaatatttgccagacctaagagtatgatatgtatgtactatatggttatgtagacatagcattattatcccgttaaaaacgagagcaaatacttgtttcttataatagccaatgctatcagaagacttaaaaactaatggattttatcactttacaaattgttatgtagacatcctttttttcctaataaaaaaagaatgtgttgataggtattctgacaccaaaactgcccaaaaatagcactataaattagaacatatttttcagtctcagggtagtagtcatctgtatttaagttttgtgtgatttagagaaatttcataaattaatttctgtaggactttatattaacaatttattcatattcttttcttctaaggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcaaaaaaaaaaaaaaaaaaaaaaaaaaaaaaaaaaaaaaaaaaaaaaaaaaaaaaaaaaaaaaaaaaaaaaaaaaaaaaanaaaaaaaaaaaaaaaaaaaggggggggggggggcggaaaaaaaccccgggggggggggaaagagacgtaccacccaccaatcattttaagaaaaaagcggcgccaaacaaggagggcaaataataaaagagagcacggccgagcgataaaacacggcgaggggagagcacagcctcgagtggagctgtagggaacaccacctcgtcgggggggaaaacagaggagacccaccacaagagaaaacgcgcgaggacaaacaacacgcgggtggagggcagcccagcctctggcgagaaagctgccagaatgaaaaaaataag

SEQ ID NO: 287773 - DNA, 2980 bp, Homo sapiens
  misc_feature (1)..(1): n is a, c, g, or t
  misc_feature (12)..(12): n is a, c, g, or t
  misc_feature (19)..(19): n is a, c, g, or t
naaaatactccntgcgccntggttcatgtgagtatctgtattttttatttctctatgtactaaaaaaagcatttctctacataatgaactatttttttttctaggtggagtaatgtatataacgtaattatattctaattaattgttatgcttatttttacaggtagaattagaagatcatgtgatgttggagtaggagggtttatcttggtgactttgggatgctggtatgtttgctaagtattcaagaacatccatgattatagtaggttatctaattcaaaaagcacatgctcttttcagagcagtctcccattgggagatcctcaccctcaatgaagaatcttgatttttcaggacattttcatggaaatcttaaaatgcttgaacagataaatgcatattagacatcccattaaaaagaaagctgtggtttttacacttcacttaggaaagcctcaaccatttcccttaccctaatacttatttcatccctgcttattcatatctgaaaatgctactttaagaatgtgtttacaactactgatgagtgaatataaaatatggatgaacctcaaatatttgccagacctaagagtatgatatgtatgtactatatggttatgtagacatagcattattatcccgttaaaaacgagagcaaatacttgtttcttataatagccaatgctatcagaagacttaaaaactaatggattttatcactttacaaattgttatgtagacatcctttttttcctaataaaaaaagaatgtgttgataggtattctgacaccaaaactgcccaaaaatagcactataaattagaacatatttttcagtctcagggtagtagtcatctgtatttaagttttgtgtgatttagagaaatttcataaattaatttctgtaggactttatattaacaatttattcatattcttttcttctaaggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattaaaata

SEQ ID NO: 287774 - DNA, 3920 bp, Homo sapiens
ccacttctgagcattttacagttcagtgtacttaactgtaaaggtatacaggctcaagtcgttgcatattcttcctgttttgatagaaattgcagggatttatgtactgaatcttattactccttagatatgtgacaactggaaagctccccaccaaaccctccagccttggttacttcttaatgatgtggtttggcacaatgaaaatgtcataggctttgtggtgaaactgacttctgcctccactcctgccaacacttattattagcctcttaagtccccgagcctgtttcagaggtaatctcacacaaaggctagagaattaaaaaacatgtagagagcctggcactaatacctacctcccccaccagcagctcttaattatgagatcaaccactattattttagaccagagttttgttggggattgggtttgtttcagaaggcactattttaaataagatgtgtagcttctatttagatatttgcctttaaagtcagctgagctattttcctattgtttgcaaatttacttttatttaaaaaaataaaatttcctaaagcagtgtttccccaatatgacagtcatcagaaaaaaccacctagagttttctaaacatagattccagtgattgtaaatcagaatctgagagtgggactagaaaatacttaattctatcctgtggtacaagctggtctcacacttgcatctttgcacctaagactagatcaaactggtactaatcctctggccccagcatcccatccttggggaaatagtctagtttagaggtagtcctggactggagcgctaagtccagcattcctcacctgcataacactacccacatgatcatatgtcccctgggctctcaagctgataggaaaaagtcgtcttgctaaatgaaatcccccaacctcttggtaatgtgaagaactgtactgcaaagctttgaagcaatcctatgttaggcatgcgggtgggaacggggccagacagagggaaaaaatggaatagaatgatccgagagtaaataattcttgctttattatgaaccaagtcacattttgtctcttccaacagatgcttgagccaaaaaagcaaacataggcagaaatacaattgagaatatcttcatgtttcaacctttaatctgacttgccttttactatcctttccccatttcttctaatctcttttgccttacaatatattaccttctaggtatcacctcatcctatagaatcccttctagtttaatgtcctgccccaaacaatactaacccattgaagataactatgaaacctttaaatggacagtggttccttttaaaagcagccttactgaaaattttatatacacttaaatcaagtaacagttaccgtgagttttctaaacttttgtgttaacagaaatgccagttcagcagtgtgactgttacttttaaatgtctgtcttgccgccctagagtgacagacatcccagttaaacatattaggaataagaaatacataaatccaatgaagactgtagaaaaagaattttagcacttgaaggaacttcagtcatttaacccaacccattcatgttatagattgagaccatagaaataaaagtagcctataggatacaaaagttagcggcagatctgagataaaaatccagctctttggatccccgcgtttttcaccacacttagctgtcgttcccatgtattacgaacaaagaatcaaatataatcaagtgcagcctcacttcacaggcaagaaaacagactagagtttaatatattgcccatgtttatcttaaggtgaaacatttactcttacaaccacagttgatgttaacctagttaataaaatatgaaaggtaattactaggggaattttaaacggcactacataagcaaacatgactcaaattactttttccatttctgcttcccaaattattggagttactgaagcaagctatgctgctttcaattccaatgataggcatattcccaaataaactcatttaaagagctcataaaatgaattatcctatttccaagtcagttgattagcaaattaagatacagctccaagttaccctactgcttaagggttttccggtccaatttgtaaggttttcggatttaaagattcagactgcataccaaaggtggacaaagacaacgcaagctgatttaggttgtcacgtggcacatactctagtttaaaccctcaactacaagaaaagaaatggtgtattgtcatttttgccaaagcaccccaaaatgaaatactttcttactcaatctaggttcttttttttcattctagtcccttaagctcctaggatttttagatgttgaaaatactccctgcgcccggcattcaatattgtatggttcattaggatctgttgtggctggctttggacattttttgttcactagtgagtatctgtattttttatttctctatgtactaaaaaaagcatttctctacataatgaactatttttttttctaggtggagtaatgtatataacgtaattatattctaattaattgttatgcttatttttacaggtagaattagaagatcatgtgatgttggagtaggagggtttatcttggtgactttgggatgctggtatgtttgctaagtattcaagaacatccatgattatagtaggttatctaattcaaaaagcacatgctcttttcagagcagtctcccattgggagatcctcaccctcaatgaagaatcttgatttttcaggacattttcatggaaatcttaaaatgcttgaacagataaatgcatattagacatcccattaaaaagaaagctgtggtttttacacttcacttaggaaagcctcaaccatttcccttaccctaatacttatttcatccctgcttattcatatctgaaaatgctactttaagaatgtgtttacaactactgatgagtgaatataaaatatggatgaacctcaaatatttgccagacctaagagtatgatatgtatgtactatatggttccatttatacatgaatttctacagtgagctatttaaggtggtagaaatcatgttatgtagacatagcattattatcccgttaaaaacgagagcaaatacttgtttcttataatagccaatgctatcagaagacttaaaaactaatggattttatcactttacaaattgttatgtagacatcctttttttcctaataaaaaaagaatgtgttgataggtattctgacaccaaaactgcccaaaaatagcactataaattagaacatatttttcagtctcagggtagtagtcatctgtatttaagttttgtgtgatttagagaaatttcataaattaatttctgtaggactttatattaacaatttattcatattcttttcttctaaggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatgaagcaggaagcggcagaagcaggaagcagccgggcggcagaagcaggaagcaggcagaagcaggaagcaggcagaagcaggaagcaagggtcttgggcagaagcaggaagcgcttcctgcttctgcccttcctgcttctgcttcctgcttctgcctcagggtcgtcaaaaaaaaccttccggtaacgcttccgcggtgttttctctcctttccaccactttttcatgtatttctgcttcctgcttctgcctggggcatggtgggttttgatcttcttccccttcttttcttccccttcttctttcctctttgatcttcgtgcttcctgcttctgccaggtctgtgacggacc

SEQ ID NO: 287775 - DNA, 2702 bp, Homo sapiens
gggagctggtatggctaagtaccagagcagtctcccattgggagatcctcaccctcaatgaagaatcttgatttttcaggacattttcatggaaatcttaaaatgcttgaacagataaatgcatattagacatcccattaaaaagaaagctgtggtttttacacttcacttaggaaagcctcaaccatttcccttaccctaatacttatttcatccctgcttattcatatctgaaaatgctactttaagaatgtgtttacaactactgatgagtgaatataaaatatggatgaacctcaaatatttgccagacctaagagtatgatatgtatgtactatatggttatgtagacatagcattattatcccgttaaaaacgagagcaaatacttgtttcttataatagccaatgctatcagaagacttaaaaactaatggattttatcactttacaaattgttatgtagacatcctttttttcctaataaaaaaagaatgtgttgataggtattctgacaccaaaactgcccaaaaatagcactataaattagaacatatttttcagtctcagggtagtagtcatctgtatttaagttttgtgtgatttagagaaatttcataaattaatttctgtaggactttatattaacaatttattcatattcttttcttctaaggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattaaaata

SEQ ID NO: 287776 - DNA, 2801 bp, Homo sapiens
  misc_feature (15)..(15): n is a, c, g, or t
  misc_feature (23)..(23): n is a, c, g, or t
  misc_feature (29)..(29): n is a, c, g, or t
  misc_feature (34)..(35): n is a, c, g, or t
gtaaaaaaattttanaaagtggngttttnaaggnntgttatctaattcaaaaagcacatgctcttttcagagcagtctcccattgggagatcctcaccctcaatgaagaatcttgatttttcaggacattttcatggaaatcttaaaatgcttgaacagataaatgcatattagacatcccattaaaaagaaagctgtggtttttacacttcacttaggaaagcctcaaccatttcccttaccctaatacttatttcatccctgcttattcatatctgaaaatgctactttaagaatgtgtttacaactactgatgagtgaatataaaatatggatgaacctcaaatatttgccagacctaagagtatgatatgtatgtactatatggttccatttatacatgaatttctacagtgagctatttaaggtggtagaaatcatgttatgtagacatagcattattatcccgttaaaaacgagagcaaatacttgtttcttataatagccaatgctatcagaagacttaaaaactaatggattttatcactttacaaattgttatgtagacatcctttttttcctaataaaaaaagaatgtgttgataggtattctgacaccaaaactgcccaaaaatagcactataaattagaacatatttttcagtctcagggtagtagtcatctgtatttaagttttgtgtgatttagagaaatttcataaattaatttctgtaggactttatattaacaatttattcatattcttttcttctaaggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattaaaata

SEQ ID NO: 287777 - DNA, 2589 bp, Homo sapiens
gctggtaccggccggagatttatggatcggggctgtctggctcggttacgcccccacctcgccaggaatctaggagtcggtttgttttccgaacccatctccttccgctctcccgcccctgcaggctgtgtgccgagcttggaagaaagtgtgacccgttcgacggaacaaaggacatgacagcccggccccgtgcggccactgcggagcgttaggaacattccctaaaatggcggccggcgcgtcggaacagggcgggaggcggcggcgcgtgggggcgggacggggaggggcgcggccagccgggcttctgcttccgcgaccccggcggtgcagggcgggtggagtcgcggagtagtcctcatggccgccccgccggagcccgtcccttaagctcctaggatttttagatgttgaaaatactccctgcgcccggcattcaatattgtatggttcattaggatctgttgtggctggctttggacattttttgttcactagtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattaaaata

SEQ ID NO: 287778 - DNA, 2244 bp, Homo sapiens
ccaggcatcttgtacgtcgttacatttatcatattggaagtcccttaagctcctaggatttttagatgttgaaaatactccctgcgcccggcattcaatattgtatggttcattaggatctgttgtggctggctttggacattttttgttcactagtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattaaaata

SEQ ID NO: 287779 - DNA, 3056 bp, Homo sapiens
ccacttctgagcattttacagttcagtgtacttaactgtaaaggtatacaggctcaagtcgttgcatattcttcctgttttgatagaaattgcagggatttatgtactgaatcttattactccttagatatgtgacaactggaaagctccccaccaaaccctccagccttggttacttcttaatgatgtggtttggcacaatgaaaatgtcataggctttgtggtgaaactgacttctgcctccactcctgccaacacttattattagcctcttaagtccccgagcctgtttcagaggtaatctcacacaaaggctagagaattaaaaaacatgtagagagcctggcactaatacctacctcccccaccagcagctcttaattatgagatcaaccactattattttagaccagagttttgttggggattgggtttgtttcagaaggcactattttaaataagatgtgtagcttctatttagatatttgcctttaaagtcagctgagctattttcctattgtttgcaaatttacttttatttaaaaaaataaaatttcctaaagcagtgtttccccaatatgacagtcatcagaaaaaaccacctagagttttctaaacatagattccagtgattgtaaatcagaatctgagagtgggactagaaaatacttaattctatcctgtggtacaagctggtctcacacttgcatctttgcacctaagactagatcaaactggtactaatcctctggccccagcatcccatccttggggaaatagtctagtttagaggtagtcctggactggagcgctaagtccagcattcctcacctgcataacactacccacatgatcatatgtcccctgggctctcaagctgataggaaaaagtcgtcttgctaaatgaaatcccccaacctcttggtaatgtgaagaactgtactgcaaagctttgaagcaatcctatgttaggcatgcgggtgggaacggggccagacagagggaaaaaatggaatagaatgatccgagagtaaataattcttgctttattatgaaccaagtcacattttgtctcttccaacagatgcttgagccaaaaaagcaaacataggcagaaatacaattgagaatatcttcatgtttcaacctttaatctgacttgccttttactatcctttccccatttcttctaatctcttttgccttacaatatattaccttctaggtatcacctcatcctatagaatcccttctagtttaatgtcctgccccaaacaatactaacccattgaagataactatgaaacctttaaatggacagtggttccttttaaaagcagccttactgaaaattttatatacacttaaatcaagtaacagttaccgtgagttttctaaacttttgtgttaacagaaatgccagttcagcagtgtgactgttacttttaaatgtctgtcttgccgccctagagtgacagacatcccagttaaacatattaggaataagaaatacataaatccaatgaagactgtagaaaaagaattttagcacttgaaggaacttcagtcatttaacccaacccattcatgttatagattgagaccatagaaataaaagtagcctataggatacaaaagttagcggcagatctgagataaaaatccagctctttggatccccgcgtttttcaccacacttagctgtcgttcccatgtattacgaacaaagaatcaaatataatcaagtgcagcctcacttcacaggcaagaaaacagactagagtttaatatattgcccatgtttatcttaaggtgaaacatttactcttacaaccacagttgatgttaacctagttaataaaatatgaaaggtaattactaggggaattttaaacggcactacataagcaaacatgactcaaattactttttccatttctgcttcccaaattattggagttactgaagcaagctatgctgctttcaattccaatgataggcatattcccaaataaactcatttaaagagctcataaaatgaattatcctatttccaagtcagttgattagcaaattaagatacagctccaagttaccctactgcttaagggttttccggtccaatttgtaaggttttcggatttaaagattcagactgcataccaaaggtggacaaagacaacgcaagctgatttaggttgtcacgtggcacatactctagtttaaaccctcaactacaagaaaagaaatggtgtattgtcatttttgccaaagcaccccaaaatgaaatactttcttactcaatctaggttcttttttttcattctagtcccttaagctcctaggatttttagatgttgaaaatactccctgcgcccggcattcaatattgtatggttcattaggatctgttgtggctggctttggacattttttgttcactagtgagtatctgtattttttatttctctatgtactaaaaaaagcatttctctacataatgaactatttttttttctaggtggagtaatgtatataacgtaattatattctaattaattgttatgcttatttttacaggtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatacatcatgcatgatgtgattgttctgtttgttatagttagcctgtactccctttttttgttctttgtacttcccctttcattttgagtacatatatgtgtcatttgtaactgcagatttttccaattattcttcctcagtcttttcctttgggtaagtaactcagcatacataattcagccacctggtgattgtaactccaccatctctccaccaaaagaactgtagtagcatcaagctacatagcattaagttatctactatcacgatca

SEQ ID NO: 287780 - DNA, 2474 bp, Homo sapiens
gctggtaccggccggagatttatggatcggggctgtctggctcggttacgcccccacctcgccaggaatctaggagtcggtttgttttccgaacccatctccttccgctctcccgcccctgcaggctgtgtgccgagcttggaagaaagtgtgacccgttcgacggaacaaaggacatgacagcccggccccgtgcggccactgcggagcgttaggaacattccctaaaatggcggccggcgcgtcggaacagggcgggaggcggcggcgcgtgggggcgggacggggaggggcgcggccagccgggcttctgcttccgcgaccccggcggtgcagggcgggtggagtcgcggagtagtcctcatggccgccccgccggagcccggtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattaaaata

SEQ ID NO: 287781 - DNA, 2205 bp, Homo sapiens
ctcacaagaccctgctacgtatctcgcacctgaaacaagctaacatgactaacacccttaattccatccaccctcctctccctaggaggcctgcccccgcggcagaagcaggaagcgtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattaaaata

SEQ ID NO: 287782 - DNA, 2412 bp, Homo sapiens
  misc_feature (2397)..(2398): n is a, c, g, or t
  misc_feature (2406)..(2406): n is a, c, g, or t
ccacttctgagcattttacagttcagtgtacttaactgtaaaggtatacaggctcaagtcgttgcatattcttcctgttttgatagaaattgcagggatttatgtactgaatcttattactccttagatatgtgacaactggaaagctccccaccaaaccctccagccttggttacttcttaatgatgtggtttggcacaatgaaaatgtcataggctttgtggtgaaactgacttctgcctccactcctgccaacacttattattagcctcttaagtccccgagcctgtttcagaggtaatctcacacaaaggctagagaattaaaaaacatgtagagagcctggcactaatacctacctcccccaccagcagctcttaattatgagatcaaccactattattttagaccagagttttgttggggattgggtttgtttcagaaggcactattttaaataagatgtgtagcttctatttagatatttgcctttaaagtcagctgagctattttcctattgtttgcaaatttacttttatttaaaaaaataaaatttcctaaagcagtgtttccccaatatgacagtcatcagaaaaaaccacctagagttttctaaacatagattccagtgattgtaaatcagaatctgagagtgggactagaaaatacttaattctatcctgtggtacaagctggtctcacacttgcatctttgcacctaagactagatcaaactggtactaatcctctggccccagcatcccatccttggggaaatagtctagtttagaggtagtcctggactggagcgctaagtccagcattcctcacctgcataacactacccacatgatcatatgtcccctgggctctcaagctgataggaaaaagtcgtcttgctaaatgaaatcccccaacctcttggtaatgtgaagaactgtactgcaaagctttgaagcaatcctatgttaggcatgcgggtgggaacggggccagacagagggaaaaaatggaatagaatgatccgagagtaaataattcttgctttattatgaaccaagtcacattttgtctcttccaacagatgcttgagccaaaaaagcaaacataggcagaaatacaattgagaatatcttcatgtttcaacctttaatctgacttgccttttactatcctttccccatttcttctaatctcttttgccttacaatatattaccttctaggtatcacctcatcctatagaatcccttctagtttaatgtcctgccccaaacaatactaacccattgaagataactatgaaacctttaaatggacagtggttccttttaaaagcagccttactgaaaattttatatacacttaaatcaagtaacagttaccgtgagttttctaaacttttgtgttaacagaaatgccagttcagcagtgtgactgttacttttaaatgtctgtcttgccgccctagagtgacagacatcccagttaaacatattaggaataagaaatacataaatccaatgaagactgtagaaaaagaattttagcacttgaaggaacttcagtcatttaacccaacccattcatgttatagattgagaccatagaaataaaagtagcctataggatacaaaagttagcggcagatctgagataaaaatccagctctttggatccccgcgtttttcaccacacttagctgtcgttcccatgtattacgaacaaagaatcaaatataatcaagtgcagcctcacttcacaggcaagaaaacagactagagtttaatatattgcccatgtttatcttaaggtgaaacatttactcttacaaccacagttgatgttaacctagttaataaaatatgaaaggtaattactaggggaattttaaacggcactacataagcaaacatgactcaaattactttttccatttctgcttcccaaattattggagttactgaagcaagctatgctgctttcaattccaatgataggcatattcccaaataaactcatttaaagagctcataaaatgaattatcctatttccaagtcagttgattagcaaattaagatacagctccaagttaccctactgcttaagggttttccggtccaatttgtaaggttttcggatttaaagattcagactgcataccaaaggtggacaaagacaacgcaagctgatttaggttgtcacgtggcacatactctagtttaaaccctcaactacaagaaaagaaatggtgtattgtcatttttgccaaagcaccccaaaatgaaatactttcttactcaatctaggttcttttttttcattctagtcccttaagctcctaggatttttagatgttgaaaatactccctgcgccctcgcccaggttatcccagnncacgaacnttgtaa

SEQ ID NO: 287783 - DNA, 1982 bp, Homo sapiens
actatatgtaacacgtaagaatgctatcctggcagtagacacagggccagaataaactggcaagttttcaattaccccaagtgtgggaaaaaaatgaccttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattaaaata

SEQ ID NO: 287784 - DNA, 859 bp, Homo sapiens
cgcgccggagacggttagaaatggcggttggggcggagcagggggctggcgcgggaagcggggctgtctggctcggttacgcccccacctcgccaggaatctaggagtcggtttgttttccgaacccatctccttccgctctcccgcccctgcaggctgtgtgccgagcttggaagaaagtgtgacccgttcgacggaacaaaggacatgacagcccggccccgtgcggccactgcggagcgttaggaacattccctaaaatggcggccggcgcgtcggaacagggcgggaggcggcggcgcgtgggggcgggacggggaggggcgcggccagccgggcttctgcttccgcgaccccggcggtgcagggcgggtggagtcgcggagtagtcctcatggccgccccgccggagcccggtgagcccgaggagaggaagtcccttaagctcctaggatttttagatgttgaaaatactccctgcgcccggcattcaatattgtatggttcattaggatctgttgtggctggctttggacattttttgttcactagtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtca

SEQ ID NO: 287785 - DNA, 713 bp, Homo sapiens
gctggtaccggccggagatttatggatcggggctgtctggctcggttacgcccccacctcgccaggaatctaggagtcggtttgttttccgaacccatctccttccgctctcccgcccctgcaggctgtgtgccgagcttggaagaaagtgtgacccgttcgacggaacaaaggacatgacagcccggccccgtgcggccactgcggagcgttaggaacattccctaaaatggcggccggcgcgtcggaacagggcgggaggcggcggcgcgtgggggcgggacggggaggggcgcggccagccgggcttctgcttccgcgaccccggcggtgcagggcgggtggagtcgcggagtagtcctcatggccgccccgccggagcccggtgagcccgaggagaggaaggtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtca

SEQ ID NO: 287786 - DNA, 1283 bp, Homo sapiens
gctggtaccggccggagatttatggatcggggctgtctggctcggttacgcccccacctcgccaggaatctaggagtcggtttgttttccgaacccatctccttccgctctcccgcccctgcaggctgtgtgccgagcttggaagaaagtgtgacccgttcgacggaacaaaggacatgacagcccggccccgtgcggccactgcggagcgttaggaacattccctaaaatggcggccggcgcgtcggaacagggcgggaggcggcggcgcgtgggggcgggacggggaggggcgcggccagccgggcttctgcttccgcgaccccggcggtgcagggcgggtggagtcgcggagtagtcctcatggccgccccgccggagcccggtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttacactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattaaaata

SEQ ID NO: 287787 - DNA, 859 bp, Homo sapiens
cgcgccggagacggttagaaatggcggttggggcggagcagggggctggcgcgggaagcggggctgtctggctcggttacgcccccacctcgccaggaatctaggagtcggtttgttttccgaacccatctccttccgctctcccgcccctgcaggctgtgtgccgagcttggaagaaagtgtgacccgttcgacggaacaaaggacatgacagcccggccccgtgcggccactgcggagcgttaggaacattccctaaaatggcggccggcgcgtcggaacagggcgggaggcggcggcgcgtgggggcgggacggggaggggcgcggccagccgggcttctgcttccgcgaccccggcggtgcagggcgggtggagtcgcggagtagtcctcatggccgccccgccggagcccggtgagcccgaggagaggaagtcccttaagctcctaggatttttagatgttgaaaatactccctgcgcccggcattcaatattgtatggttcattaggatctgttgtggctggctttggacattttttgttcactagtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcgagtagatcacactaacattatggcatagttcatagtataagtagtgatcaaaaaattggtccatatgctggcatccttgcgtggaactaagctacatcctc

SEQ ID NO: 287788 - DNA, 1220 bp, Homo sapiens
  misc_feature (728)..(729): n is a, c, g, or t
gctggtaccggccggagatttatggatcggggctgtctggctcggttacgcccccacctcgccaggaatctaggagtcggtttgttttccgaacccatctccttccgctctcccgcccctgcaggctgtgtgccgagcttggaagaaagtgtgacccgttcgacggaacaaaggacatgacagcccggccccgtgcggccactgcggagcgttaggaacattccctaaaatggcggccggcgcgtcggaacagggcgggaggcggcggcgcgtgggggcgggacggggaggggcgcggccagccgggcttctgcttccgcgaccccggcggtgcagggcgggtggagtcgcggagtagtcctcatggccgccccgccggagcccggtgagcccgaggagaggaaggtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatattggcaatgcaaccgtcacttatccagtgaaccactatcagaaaagaagactctacctctctatagtaatctccctacaaatctccttagttataacattcaccacgtcacctggtnntactaactcatatttaatatcttcttcgaagaccaacaattttaatcccccaaacgctttggggggcgttaatttaatttcacacccccccgggagattttggaagggtgggacccacaaaaaagcctactcataagtgtccccaaaagttgtaaaacacacgcggggcccccgtgtgtaaaacaagcgccgtgtgacacagaggtgtggttgaccacaaacccaaaattttttttcaacaccaccgtttttatttcgacccgaccgatattaaaaaaatttttttcccacccgatttaaaaaagccaaaaaaacaccaccaacctcattttaaagaagagcattatatcagcaaggtgcaccaaaactttttacaccccacacacgtattttttttacaccacacaccaccacgactcatgtttataaaaaagcaccagttttttcccacaacaagtttttttcccgagggagatcagacacaaacaatc

SEQ ID NO: 287789 - DNA, 647 bp, Homo sapiens
gctggtaccggccggagatttatggatcggggctgtctggctcggttacgcccccacctcgccaggaatctaggagtcggtttgttttccgaacccatctccttccgctctcccgcccctgcaggctgtgtgccgagcttggaagaaagtgtgacccgttcgacggaacaaaggacatgacagcccggccccgtgcggccactgcggagcgttaggaacattccctaaaatggcggccggcgcgtcggaacagggcgggaggcggcggcgcgtgggggcgggacggggaggggcgcggccagccgggcttctgcttccgcgaccccggcggtgcagggcgggtggagtcgcggagtagtcctcatggccgccccgccggagcccggtgagcccgaggagaggaagtcccttaagctcctaggatttttagatgttgaaaatactccctgcgcccggcattcaatattgtatggttcattaggatctgttgtggctggctttggacattttttgttcactaaggattagaggatcatgttatgttgggagtagggaggtttatctgggcacttggggaatcctggttaaataggggtataattatacaaagcaaagactccaggaagatcaccaacgagtaattaaaa

SEQ ID NO: 287790 - DNA, 410 bp, Homo sapiens
ctattcctctcacgtgagtctgggttcctttgttgtggttgatgtttcttcatatgtgtgtggggtccttggtgagggtttttcctgtacatttttctccatagttgcaagcccatgatgccactttgaaatgcttgcctatgttatttaaaacctaggggtgctggccttggaagctctcagctgtcccttgtttaccttggtcctcatgagcctttatgggtgggaaggcgacatcagggatactttttctccatgaataatcagcatggggcatcctcaggagcgcgacagcagatgtaaagcccaggatgccagacttgtccatagttactaaagtggtgtatttctttacatttgccatgttgcagatcatttgttttgataagcatgacatgatggcttaatga

SEQ ID NO: 287791 - DNA, 328 bp, Homo sapiens
ggcctcatttattttttaaggtcttggtaaaacatcctgaaatgtgtcttcagtagtacgttgctaccttatttccaaggaaatcttgcaaattcaggtttagactaaaattttgtttggtgagactttttatttaaaaacaaaaactttaaagtggggagggaagaacagtcattaatcaccttcatcacgttttcacctgaagcaaatggagttctcctactcagttccacctccacctgctagttcacctttcctcggctgtttctgttttatgtggttcaatttttcaataaactacgtcatcttctactctatatatcatcaa

SEQ ID NO: 287792 - DNA, 2167 bp, Homo sapiens
gccacagcgaatacaggtgaccgtatcctgagccccgggcagaggcaggaccgagccgcaatctgaacagaaatccaggtccgactgaaagctggagcaagtattggcgaggtccatgacagacatgcggtcgggtctgaggagggagttggaagtttattaacaaaagagagaagagttcctgtcccagaggtcgtaactattctgtcccaggacctaggagtatataacccgaaccctcctgccacgcacgcctcctgcctctgcgaccaaggagccgaaacgcccggaattcccagacagcgtcgggtactaaaggacttggaaccctttccaggggccggtgagaggagttaaccaactccgtgggctagagcgccagctctgcgcccgcggcggggcagcgagatagagccggctagagcgtcaggctttcgcgttgacgattggctgtgacgtcataattaattgcgaaccgtgtctcgggagcgttagagatggagactaacgtcttccaagggagattgcgtctccactttcaccctggtactgagaggttgagcacaaaattggtaaccaatgctgcgcttccagcaaattttcccaccagcacccaatcctgggatatttattctctttgtctcacatcctacaggaacgcagtcgcggggtatatccccctgaaaaccgtacgttgccaaataatgatttctttggattagagaactacaactcccctgggtcctgagccggtatttcccttttgcggctgcaccgtagttaaaaacaaagctaagtgttctgggacgtatagttctagcgttccttgggtcccgctggcgagcgtgggctttctgcagctcgcaaccggcctcgtgctttgcggacggttcactgcgcttggaaagggattggcctggggtacatcatctaaagatcctaggattgctgcaggtcagcagtctccactggaaaaaaagatcttgaatctaggtggtgtgcatacaacagcagcaagacagttgataatgcagaaatatcaggaggagtgtgaaatactctgtagggagcaagctgtttctcttgactactggcttgccaaagcagagtcttattataataaaataatagtggaaatgatgaaagaagagacaggcaatgaaatctagaaaaaaatggaggagaaaacaacccagagcgtagaaggactaaaacagtactgtttggtacctgagagagagatgaaacacatagaaaggcacatacatcaaacaggaaaggctggagaatttaagaacaaaccatttagacaagtactacaaccccccaatgaaacaaaattaccaaaaattatgccagaagggcatggcatccagaacgcacagagaagaaagcaggtaaatgagagggaacagatgcagactaaggatcaccaggaacgcatgattcgagggagagaacttgcagaacaaagactcaaggagagaatcttgagaagaagccagagccagctacttacatatgagaagcatgagagagtaaaagagataaaggagtttgaaagagttattgcgtatcttcttttccaaccatgcagtagaagtcggattaaacatgtatttcaagtcctctgatgaatcatgtgatctactagaccctgaagatacagtgaagagcaaaagtaagatgctggcaatttgatgtttgcactgtcatgaaggagatgcacatttagcagaacttacaaagagaaatataaaattactgctgagctaagtgtggtgaagaaaagttcatggtaccatgaaagcagataaccaggagatctaacaggtccactaccactattctcaataatacctaaaagaaataataagatatggcatttataaatgatgaataggattttataaaattatatacaatcagagaaccaaaaagcactcttggaaatcaaaaagtgatcatttaaataagtatttcaatagatcacttggaagagtaaatttgtactaccactaaatattaaaaatggaaaaacaatgtcaagaaagacagaaaaactatacgaatactaggctatcagtcaaggatttcctgcaacttaataatacaaattctaaaagaatggaaagatagaaattatttaaaataaaaaaatttctcc

SEQ ID NO: 287793 - DNA, 1512 bp, Homo sapiens
gccacagcgaatacaggtgaccgtatcctgagccccgggcagaggcaggaccgagccgcaatctgaacagaaatccaggtccgactgaaagctggagcaagtattggcgaggtccatgacagacatgcggtcgggtctgaggagggagttggaagtttattaacaaaagagagaagagttcctgtcccagaggtcgtaactattctgtcccaggacctaggagtatataacccgaaccctcctgccacgcacgcctcctgcctctgcgaccaaggagccgaaacgcccggaattcccagacagcgtcgggtactaaaggacttggaaccctttccaggggccggtgagaggagttaaccaactccgtgggctagagcgccagctctgcgcccgcggcggggcagcgagatagagccggctagagcgtcaggctttcgcgttgacgattggctgtgacgtcataattaattgcgaaccgtgtctcgggagcgttagagatggagactaacgtcttccaagggagattgcgtctccactttcaccctggtactgagaggttgagcacaaaattggtaaccaatgctgcgcttccagcaaattttcccaccagcacccaatcctgggatatttattctctttgtctcacatcctacaggaacgcagtcgcggggtatatccccctgaaaaccgtacgttgccaaataatgatttctttggattagagaactacaactcccctgggtcctgagccggtatttcccttttgcggctgcaccgtagttaaaaacaaagctaagtgttctgggacgtatagttctagcgttccttgggtcccgctggcgagcgtgggctttctgcagctcgcaaccggcctcgtgctttgcggacggttcactgcgcttggaaagggattggcctggggtacatcatctaaagatcctaggattgctgcaggtcagcagtctccactggaaaaaaagatcttgcatgtatttcaagtcctctgatgaatcatgtgatctactagaccctgaagatacagtgaagagcaaaagaacacggatgaaatgagaaacaaaaacgatggagaaaaccaaaaaaggggacacatgggatccaggcaataggagagccagcataagagagaggcagagggatgcccaggatgaggtgaagacgatcttggaaatcagcccagatgtgcatgcaccagtccacgtgtggcaggaccaagggaagtgtcttcacaaagatgaggctttgatttgttggagaaactgttaccagaaaaacaggtcccgatcccgaccccaaaagagtattcttggatcttgcacaggaaggaattaaaggtctagctctgtctcctcagcacatgttctaggctctgactgcaagtgctgacttggctcccagccccaccagaccctctgttccatgaaagggccatctatgcaaagtgccccccaaatgccaaaggagccaataaaccaaggaacaagacagacaaat

SEQ ID NO: 287794 - DNA, 2592 bp, Homo sapiens
gccacagcgaatacaggtgaccgtatcctgagccccgggcagaggcaggaccgagccgcaatctgaacagaaatccaggtccgactgaaagctggagcaagtattggcgaggtccatgacagacatgcggtcgggtctgaggagggagttggaagtttattaacaaaagagagaagagttcctgtcccagaggtcgtaactattctgtcccaggacctaggagtatataacccgaaccctcctgccacgcacgcctcctgcctctgcgaccaaggagccgaaacgcccggaattcccagacagcgtcgggtactaaaggacttggaaccctttccaggggccggtgagaggagttaaccaactccgtgggctagagcgccagctctgcgcccgcggcggggcagcgagatagagccggctagagcgtcaggctttcgcgttgacgattggctgtgacgtcataattaattgcgaaccgtgtctcgggagcgttagagatggagactaacgtcttccaagggagattgcgtctccactttcaccctggtactgagaggttgagcacaaaattggtaaccaatgctgcgcttccagcaaattttcccaccagcacccaatcctgggatatttattctctttgtctcacatcctacaggaacgcagtcgcggggtatatccccctgaaaaccgtacgttgccaaataatgatttctttggattagagaactacaactcccctgggtcctgagccggtatttcccttttgcggctgcaccgtagttaaaaacaaagctaagtgttctgggacgtatagttctagcgttccttgggtcccgctggcgagcgtgggctttctgcagctcgcaaccggcctcgtgctttgcggacggttcactgcgcttggaaagggattggcctggggtacatcatctaaagatcctaggattgctgcaggtcagcagtctccactggaaaaaaagatcttggctttgatttgttggagaaactgttaccagaaaaacaggtcccgatcccgaccccaaaagagtattcttggatcttgcacaggaaggaattaaaggggtacactcctttggaaaccagaacctcgtatcctgcacagcccagtgttgggagataaaatatgcgaaataccccattgagtgaatctaagagattggacatggagccaaacctgcttccgccttttgatttctggacacacatgttcttcctattgagaacacagaactctagagacgtctctgattcaaacaatgcactgtgtcctgaaagatggcacccacccctcagagtgcttcctccaggctggcactgagttgtgcctgtagaagacctgtccagccttccttgtggctggcagctcctgggtagtgcagatggtgataggattagtggaacccacagccgtggaaacactgaaactttccctgcaaagtgggtccttcaggcagataatgggctaggagcactgcctagcctgcagaccaggaatgtcaacagcacccagagagtggtgctggctgtgtctgagagcaggacaggaaaacccacccatagaatcggtacctaaccctgtgaagatgaaactctggcccttccaggtggaagtagctaaatgtagtcaacttgttacttagtgggtagtcatgtaaagaaatagtgccccactagggcacatcatgggcctcaattgctgatgagttggacattcagaggtggcagcagctggatctgccttggtgtggggaagtcagtgctgctggccccttacggagcctcatgcctgccactgtggttgctccattcatgcactcatcctaccaggcctgggctgacccatggtgaaagctggctaactgccatttgtctgtttggtagttcagtgccacttcagacttgggtgttttctgtgggtgtcagcaagggattcaagctcaacccaggtggactgttttcacctgatgatgaatgctgttgggcctgtaccatctatgactttgtgggtcacacaggcacttggaaccccgtagttgcttggtatcccgtggtcaaacattctattgaatcaggacaaggaacactaaaagttgcttctaacagggggcatgtgtctctgctgtggatgacatgatcttactccagaatcccaggccctccactgtgactctcccactggtgcttggttcagctccatcctgtgtctttccccaccactggcaccaccagccccaggggtctgagggatggtggctgcttgtaccatggcctggatctgctgcagggtcctttcctgtgtaggccccacttgaagctggcatcctcctatgtcacctagactgtgggccaaagcaaaatgtctagatgtggaatgtggtgttgttataattcaaagaggctcaccaagcagtgtgcttccttgcttctggtgaggatgcaagatgcaacagtttttcttttaccttggaggggacacacctgcattcccctaaacacttggcacttgttcacccataaaacttcacttcagtgcccacctttgaagctgtataaggtttatcttcaccttgt

SEQ ID NO: 287795 - DNA, 2685 bp, Homo sapiens
gccacagcgaatacaggtgaccgtatcctgagccccgggcagaggcaggaccgagccgcaatctgaacagaaatccaggtccgactgaaagctggagcaagtattggcgaggtccatgacagacatgcggtcgggtctgaggagggagttggaagtttattaacaaaagagagaagagttcctgtcccagaggtcgtaactattctgtcccaggacctaggagtatataacccgaaccctcctgccacgcacgcctcctgcctctgcgaccaaggagccgaaacgcccggaattcccagacagcgtcgggtactaaaggacttggaaccctttccaggggccggtgagaggagttaaccaactccgtgggctagagcgccagctctgcgcccgcggcggggcagcgagatagagccggctagagcgtcaggctttcgcgttgacgattggctgtgacgtcataattaattgcgaaccgtgtctcgggagcgttagagatggagactaacgtcttccaagggagattgcgtctccactttcaccctggtactgagaggttgagcacaaaattggaacgcagtcgcggggtatatccccctgaaaaccgtacgttgccaaataatgatttctttggattagagaactacaactcccctgggtcctgagccggtatttcccttttgcggctgcaccgtagttaaaaacaaagctaagtgttctgggacgtatagttctagcgttccttgggtcccgctggcgagcgtgggctttctgcagctcgcaaccggcctcgtgctttgcggacggttcactgcgcttggaaagggattggcctggggtacatcatctaaagatcctaggattgctgcaggtcagcagtctccactggaaaaaaagatcttgcatgtatttcaagtcctctgatgaatcatgtgatctactagaccctgaagatacagtgaagagcaaaagaacacggatgaaatgagaaacaaaaacgatggagaaaaccaaaaaaggggacacatgggatccaggcaataggagagccagcataagagagaggcagagggatgcccaggatgaggtgaagacgatcttggaaatcagcccagatgtgcatgcaccagtccacgtgtggcaggaccaagggaagtgtcttcacaaagatgaggggtacactcctttggaaaccagaacctcgtatcctgcacagcccagtgttgggagataaaatatgcgaaataccccattgagtgaatctaagagattggacatggagccaaacctgcttccgccttttgatttctggacacacatgttcttcctattgagaacacagaactctagagacgtctctgattcaaacaatgcactgtgtcctgaaagatggcacccacccctcagagtgcttcctccaggctggcactgagttgtgcctgtagaagacctgtccagccttccttgtggctggcagctcctgggtagtgcagatggtgataggattagtggaacccacagccgtggaaacactgaaactttccctgcaaagtgggtccttcaggcagataatgggctaggagcactgcctagcctgcagaccaggaatgtcaacagcacccagagagtggtgctggctgtgtctgagagcaggacaggaaaacccacccatagaatcggtacctaaccctgtgaagatgaaactctggcccttccaggtggaagtagctaaatgtagtcaacttgttacttagtgggtagtcatgtaaagaaatagtgccccactagggcacatcatgggcctcaattgctgatgagttggacattcagaggtggcagcagctggatctgccttggtgtggggaagtcagtgctgctggccccttacggagcctcatgcctgccactgtggttgctccattcatgcactcatcctaccaggcctgggctgacccatggtgaaagctggctaactgccatttgtctgtttggtagttcagtgccacttcagacttgggtgttttctgtgggtgtcagcaagggattcaagctcaacccaggtggactgttttcacctgatgatgaatgctgttgggcctgtaccatctatgactttgtgggtcacacaggcacttggaaccccgtagttgcttggtatcccgtggtcaaacattctattgaatcaggacaaggaacactaaaagttgcttctaacagggggcatgtgtctctgctgtggatgacatgatcttactccagaatcccaggccctccactgtgactctcccactggtgcttggttcagctccatcctgtgtctttccccaccactggcaccaccagccccaggggtctgagggatggtggctgcttgtaccatggcctggatctgctgcagggtcctttcctgtgtaggccccacttgaagctggcatcctcctatgtcacctagactgtgggccaaagcaaaatgtctagatgtggaatgtggtgttgttataattcaaagaggctcaccaagcagtgtgcttccttgcttctggtgaggatgcaagatgcaacagtttttcttttaccttggaggggacacacctgcattcccctaaacacttggcacttgttcacccataaaacttcacttcagtgcccacctttgaagctgtataaggtttatcttcaccttgt

SEQ ID NO: 287796 - DNA, 8587 bp, Homo sapiens
  misc_feature (6276)..(6276): n is a, c, g, or t
  misc_feature (7105)..(7105): n is a, c, g, or t
  misc_feature (7834)..(7834): n is a, c, g, or t
gccacagcgaatacaggtgaccgtatcctgagccccgggcagaggcaggaccgagccgcaatctgaacagaaatccaggtccgactgaaagctggagcaagtattggcgaggtccatgacagacatgcggtcgggtctgaggagggagttggaagtttattaacaaaagagagaagagttcctgtcccagaggtcgtaactattctgtcccaggacctaggagtatataacccgaaccctcctgccacgcacgcctcctgcctctgcgaccaaggagccgaaacgcccggaattcccagacagcgtcgggtactaaaggacttggaaccctttccaggggccggtgagaggagttaaccaactccgtgggctagagcgccagctctgcgcccgcggcggggcagcgagatagagccggctagagcgtcaggctttcgcgttgacgattggctgtgacgtcataattaattgcgaaccgtgtctcgggagcgttagagatggagactaacgtcttccaagggagattgcgtctccactttcaccctggtactgagaggttgagcacaaaattggtaaccaatgctgcgcttccagcaaattttcccaccagcacccaatcctgggatatttattctctttgtctcacatcctacaggaacgcagtcgcggggtatatccccctgaaaaccgtacgttgccaaataatgatttctttggattagagaactacaactcccctgggtcctgagccggtatttcccttttgcggctgcaccgtagttaaaaacaaagctaagtgttctgggacgtatagttctagcgttccttgggtcccgctggcgagcgtgggctttctgcagctcgcaaccggcctcgtgctttgcggacggttcactgcgcttggaaaggggtgagtcggctttttgagggacagcaagtggtgagagtgaaggcccgaggaatgcttagtcccacgggacgaaaggaagcagggatgaagtggtacacttgagaaggggttcaggactttggaggtggtggaacagaggagcttggggcttcctctccttcgactcctgccagataagtgaggctagcagtagtcaagaaagctcattaagtaggatttcataagacttaggtcgagtttggcttttagttgtgcctgccgcctatcgaactcttaattcattatgtcatccgttaagtggacagctgacatttccctgatcttttataaaacatgagaataagtatctttgggaaatctttctattttcattaatctgtaacttatattccaagtagaaactttccctgaaggggcagcttgtagttgtttactagtttcctgctagccctcccaccaccatccactctgatagctgtgctaagttcattcatataaaagttctggagccatcactgttttctcctatgaaggacacaagctgtagtcttttcgctgggagaggctcccatctgcctttctctgtaataatggagagaacgccatagtgaaagggttaaaactcagcaaactgctgaagagtgacaagccctatcacttaactgtgaaattgcttgttattctgtcttacaaagggagacgtgttgttgagctgattgtcgtagacagtttttattctcacttatctgtgtgtctcctttgaaaatggaacttgaaattctaccctcctcagttttctgtttttaatttgaaaaacagccaacatcccctgtgaattgcagtaaaggaacaaagcattaaaaggcatatccttttcccaacaaaagctcacagtctaatcagtaaagatttattgagcaactatgccaggttttgagctgaggctgagcctgcaaagttgaaatctgtgttctctgacctcaaggaacatgaatgaataattagaatataataaaactgtgctagtaggtacaaaatgtgagagcccagaacatgcatataaagcaaacatatctgtaaacttcaaggaagactgggaaatggcttaataaaaatagatacaatgttatggcagatatttaaaaaagatgctcagatattatgtgtcaaggatcatcagcaatcagcaaatcattaattttgagaacttgggatcacagactctaatgttaagtattgtgctagaagccatgtacagagaagtaaaagtaagatgatcatacgtttacaatctcaaaataagcttacgtagacaaataagaatgttcctaagaggtcagtgagaccaaatatttgatatcagatcctttccaacaatatagaggcatcatatttgtagatataaattacagttttcattccttatgagcctaaatttcagcatcaaaatgttaaaagtgatatgtgaatacagatatcacagtgtaaaccacgattaattttcaaatgagttgtagaattaaaatatgtcaagtatttagaggaagggaagatcactgacagagtagactggaaagactttataatcaggagcttgacctgtgaaggacagatagatagaatttattgagaacttaccaagctctttacatctaattcatatttgttctttataaccctgagaggcagatttttgtcttacatctccattttatagatgagaaagctgacagaagttacttgccctgagtcacacacctaggaagtggtagaattagatttcagatctagctctgtcagactgtaaagaccatcctttgaactctaaatggtataaaagacatacagaggaaatgccaggcatcctcagtggcttaaatacgacatcacagtaaactcaggctagaccagggatgacacataaaagatgatagttttcatttgtgttgccatcagcctcctctataaataaacccagagtaaccacaaattgccatcctgaggggttcaacagggaatagtctcataatggatttagagtgaaggatgattggcattgttagtcaggcaagcagagggctgagcagtcaaataacagaatttcagaacaaaagattagagggcagaaatgctgtatgtgctgatagagtcagagagggcccggatcaagaaactgcaggaagagaaaactagaaacctagaatcgtctagaaaactagaacctacaatcgtctcagaacacaaaggaggcttgaggactgagcagactgacatagatgtacttggacaacacctcaccaaggagcatgtctcttcccactcacaatccccaatacgagattcacagtggttcacgctgagtccacaggaaaaattggcctggggtacatcatctaaagatcctaggattgctgcaggtcagcagtctccactggaaaaaaagatcttgaatctaggtggtgtgcatacaacagcagcaagacagttgataatgcagaaatatcaggaggagtgtgaaatactctgtagggagcaagctgtttctcttgactactggcttgccaaagcagagtcttattataataaaataatagtggaaatgatgaaagaagagacaggcaatgaaatctagaaaaaaatggaggagaaaacaacccagagcgtagaaggactaaaacagtactgtttggtacctgagagagagatgaaacacatagaaaggcacatacatcaaacaggaaaggctggagaatttaagaacaaaccatttagacaagtactacaaccccccaatgaaacaaaattaccaaaaattatgccagaagggcatggcatccagaacgcacagagaagaaagcaggtaaatgagagggaacagatgcagactaaggatcaccaggaacgcatgattcgagggagagaacttgcagaacaaagactcaaggagagaatcttgagaagaagccagagccagctacttacatatgagaagcatgagagagtaaaagagataaaggagtttgaaagagttattgcgtatcttcttttccaaccatgcagtagaagtcggattaaagtgagtattcttatggataagtctcagaatggagagaaggtgaatacaattgtgaaaccatatcaaagaaaattcttggcaatgccaccctttttaagaagtcaaataggaaaaataagagattaaagtttcaatgctgttatgataaaatcatatctcttaagtgaacccttttttttttcaaatgctcgttctctccagggttcagtgaatattcccatttgtatcagatacagatagatagttctgcacttgaaaattagcttaacttttttagttgacttgcatttgttcaagttgcatatcctttctagtgttcagtgtcctcatctttaaaatggcaataatatttgatggcatttatggaaggactgttttttttgtgaagtgtaggtatgtattagttgtttcataaatgttagtttccccacttggaaagaccggggttgggcaatggtggtgaataaagaattgttctaatctacttctcttattctccctgttcccagccctccaaggttattttgatgagattgctatagtttagtatatggtctttaatatcataccttcatcagataactactagccagcccctaaaagtgtaacttgctctgtacaatttatttgaatgagaaacttaattttgagagcctcctacatgctaggcattatgttagttactgaaggtgaataaagagaagtctctgcccttgaataattttcaactaatggcatagatcactctataaacagataatgtagtaaataaaggttacaatagaaaggtacagggtgctttacaaaggacggattctaacctggcccaggtgagcagggtgaaaaggaggaaggttagggaagggagtattatagtctgtcatgtttcttccagctttttttgtcacttcctatcacccacttaagcaagaccttcctaatgcttggatccactcagggataatcaaactcagcctttctcaaactcatgtttttggcactcattgataaatcagaaagcaaatttataaatttagtgagaattacagttgtcaagcagaatgaaatttgtgttttctagtcagtttattttcttcccagataccagaaagttgggaaagcaggggttcagagttggtaagcagagaagcaaataaatggaaatagatgccctcaggaatattatgcttaagttgtgataattctgatgcccaccttgctttactagcagaacaccctttaccctggatactgctaggtcagccactgatacaaatgttctgtgtctgtgctcctcagtacagtagcccttgctacacgtggctgttgaggcatttaaaatgtggctggtgcagctgtggaatggaatgtttaattgaatttcatttaaatttaaattgccacatgtggcaagtgactaccctgttgcacagtgtagcactggataaacataacttctgtgttctagattccagtcccaccattagctttctgtttttgacagtgtttgctggtatgataggtcactgttcattttacattactatcagtttagtttcctttgcatttcagaggctccctaatcccttaaagagatttaaaaatcaatgtagaccacttctgtgtgaaaataagatgactgaatttgctttgattggaattaggaactgacctctctttgctagttctggaatttggccaggatgcacatcaaaatctcattcctaccctcctgatttgcctcatggaaacttcgttgctgtgtctgttctctggtcctctattgctatgtctcagctttagattctatgttttgcatagaaatggatcatcagaatgcaacaggcagaagacttagaagtgcaaatcagtagggtaatgacaagccctttgagctgagtgggactgaaaagtaacctaacatataacctattagtaattgtttaccatgaaggttttcagtgctggacacataaattgctgagttcaactgccctctttcccctccaaatctagcataaaagcaactggtgctctcagggcaatttcacacctaatacggctaagaataaaagtctatgtttcaggaactcagtttgtccaaacctgcatccatcatctacctcaaattatatccaccttttcatttctttgcactgtgtctgcttaaatcttgagtcacacttaatgttttttttttggtcttttttctttttaatgtgaaatagaatatacaatacacaaatgaaaatgtatatttagaagaacaataataaatgtccaggtgccngttgctcagactgagaaatggaacattactacatcccaggagcctcgtatgctctcattcatatctctctcccctgcagccagaggcaaccactatcctgaattttgtataactgtcacctagcttttatagattttactgtctgtgtatccctaacagttgcttatttatagcctttatataaatagaattatactgtatatgactgactacttttgctcattattatttttggattcatccatgttgatgtgtgacactgtagttcatttccatgacatgaatatgccacaacttaattatatattctgttgatgtcatttagttgtttccagtttttgttttatttttcttttaaaaatgatacttagataaacattaacatgtttaatcttatgttctggtgactgtgtactagatatatgtatgatatataaattgtggtacatttatttgacaggcctgatcttgaagcctgttagatttctgttcctttgtggcattatgcctgtaagcctgttctgtagagtctggcacatgttagcctcttaatagatatttgttgaaagaaaggacatttgttaactgctggagacaggcccaaaatacataaatagctgataacagaccactttagctttttactcatcttgtccaggtacaatcatagtcaacctctgtttatgcttatatttcagttgaggtactaaaatatttgtttacttagttggttttcagtgagcttccagtacaggatttgtttctctttctgtcacttttcccaaaactttcactccactgccttctagaaaagatcacccacatgtcntctcctcaaggcacctgcagcacgaaagttttatttctgaacaaaagggtccccagagaaggagacaaggagtctcctttcagtacgaggttgctggagtccctagagggtcaaaggctgtgtaataacagttccttcttgtctgctggacaaaagcttctgagccctcaagcaccctgtgacttagttctgatagagtactgagtttggaaatggcagagtggggacccaaaacaaatcttccaattccaaattcagttttatccaccttttcaaataagattaaaaaatgttaatgtctgttgatttgtgtgtgttgaaccactcttgtatccctgggatgaatcccaattaattgtggtatatttttgatatgttgttggattcagtttgctaaaattttgttcaggatttttgtgtatattttcactaggaagattggcctgtaattttctttttttttgtattcttctctgcttttggtatcagggcaatgcaggcttcataaaatgagttaagaataattccttcctcttcagttttttttaaatattttgagaagtattggtattaatttttctttgtatgtatggtagaatttgacaggaaagccatctggtcctgggcttttctttattgagacacttttaattactgattcagtcttattactcattgttggtctgttcaagttttctatttgttcctggtgaaatgtctacaaaaatnacaaaaattagctgggtgtggtggcatgtgcatgtagtcccagctacttagggggctgaggcaggaggatcgcttgaacctcaggaggttaaggctgcagtgagctggtattgcgccactgtgttgcagcctgggtgacaaagtgagaccctatctcaaaaataaaaaaaattcatatggaaccacaaaagagccccatccaatagttaagctatagtaatagctttgtaactgttatagtagaaaccaaatcatcatggtaccggcctaaaacagacacatagaccaatggaaagaatagagaacccagaaataatttcatatacttacagccaactgactttcaacaaaggcaccaagaaaggacacccttttcaataaatggtgctgggaaaactggatatccatatgcagaagattgcagctaggctcatatctcttaccatattaaaaaatcaaccaaaaatggattaaaggcttaaatgatagatccgaaactatgaaactactaaaagagaatataggggaaatgctcaagaacattggtctaggcaaagattttatggttaagacatcaaaagcataggcaacaacaacaaaaaataggcaggtgggactatattaaactaaaaatctgcacagcaaagaaaacaacagagtgaagagaccaactgtagatgggaacaatattttcaaattatccaacaggggactaatatccagagtgtacaaggaacacaattcaacagtaaa

SEQ ID NO: 287797 - DNA, 7778 bp, Homo sapiens
  misc_feature (5467)..(5467): n is a, c, g, or t
  misc_feature (6296)..(6296): n is a, c, g, or t
  misc_feature (7025)..(7025): n is a, c, g, or t
gccacagcgaatacaggtgaccgtatcctgagccccgggcagaggcaggaccgagccgcaatctgaacagaaatccaggtccgactgaaagctggagcaagtattggcgaggtccatgacagacatgcggtcgggtctgaggagggagttggaagtttattaacaaaagagagaagagttcctgtcccagaggtcgtaactattctgtcccaggacctaggagtatataacccgaaccctcctgccacgcacgcctcctgcctctgcgaccaaggagccgaaacgcccggaattcccagacagcgtcgggtactaaaggacttggaaccctttccaggggccggtgagaggagttaaccaactccgtgggctagagcgccagctctgcgcccgcggcggggcagcgagatagagccggctagagcgtcaggctttcgcgttgacgattggctgtgacgtcataattaattgcgaaccgtgtctcgggagcgttagagatggagactaacgtcttccaagggagattgcgtctccactttcaccctggtactgagaggttgagcacaaaattggtaaccaatgctgcgcttccagcaaattttcccaccagcacccaatcctgggatatttattctctttgtctcacatcctacaggaacgcagtcgcggggtatatccccctgaaaaccgtacgttgccaaataatgatttctttggattagagaactacaactcccctgggtcctgagccggtatttcccttttgcggctgcaccgtagttaaaaacaaagctaagtgttctgggacgtatagttctagcgttccttgggtcccgctggcgagcgtgggctttctgcagctcgcaaccggcctcgtgctttgcggacggttcactgcgcttggaaaggggtgagtcggctttttgagggacagcaagtggtgagagtgaaggcccgaggaatgcttagtcccacgggacgaaaggaagcagggatgaagtggtacacttgagaaggggttcaggactttggaggtggtggaacagaggagcttggggcttcctctccttcgactcctgccagataagtgaggctagcagtagtcaagaaagctcattaagtaggatttcataagacttaggtcgagtttggcttttagttgtgcctgccgcctatcgaactcttaattcattatgtcatccgttaagtggacagctgacatttccctgatcttttataaaacatgagaataagtatctttgggaaatctttctattttcattaatctgtaacttatattccaagtagaaactttccctgaaggggcagcttgtagttgtttactagtttcctgctagccctcccaccaccatccactctgatagctgtgctaagttcattcatataaaagttctggagccatcactgttttctcctatgaaggacacaagctgtagtcttttcgctgggagaggctcccatctgcctttctctgtaataatggagagaacgccatagtgaaagggttaaaactcagcaaactgctgaagagtgacaagccctatcacttaactgtgaaattgcttgttattctgtcttacaaagggagacgtgttgttgagctgattgtcgtagacagtttttattctcacttatctgtgtgtctcctttgaaaatggaacttgaaattctaccctcctcagttttctgtttttaatttgaaaaacagccaacatccccaagctctttacatctaattcatatttgttctttataaccctgagaggcagatttttgtcttacatctccattttatagatgagaaagctgacagaagttacttgccctgagtcacacacctaggaagtggtagaattagatttcagatctagctctgtcagactgtaaagaccatcctttgaactctaaatggtataaaagacatacagaggaaatgccaggcatcctcagtggcttaaatacgacatcacagtaaactcaggctagaccagggatgacacataaaagatgatagttttcatttgtgttgccatcagcctcctctataaataaacccagagtaaccacaaattgccatcctgaggggttcaacagggaatagtctcataatggatttagagtgaaggatgattggcattgttagtcaggcaagcagagggctgagcagtcaaataacagaatttcagaacaaaagattagagggcagaaatgctgtatgtgctgatagagtcagagagggcccggatcaagaaactgcaggaagagaaaactagaaacctagaatcgtctagaaaactagaacctacaatcgtctcagaacacaaaggaggcttgaggactgagcagactgacatagatgtacttggacaacacctcaccaaggagcatgtctcttcccactcacaatccccaatacgagattcacagtggttcacgctgagtccacaggaaaaattggcctggggtacatcatctaaagatcctaggattgctgcaggtcagcagtctccactggaaaaaaagatcttgaatctaggtggtgtgcatacaacagcagcaagacagttgataatgcagaaatatcaggaggagtgtgaaatactctgtagggagcaagctgtttctcttgactactggcttgccaaagcagagtcttattataataaaataatagtggaaatgatgaaagaagagacaggcaatgaaatctagaaaaaaatggaggagaaaacaacccagagcgtagaaggactaaaacagtactgtttggtacctgagagagagatgaaacacatagaaaggcacatacatcaaacaggaaaggctggagaatttaagaacaaaccatttagacaagtactacaaccccccaatgaaacaaaattaccaaaaattatgccagaagggcatggcatccagaacgcacagagaagaaagcaggtaaatgagagggaacagatgcagactaaggatcaccaggaacgcatgattcgagggagagaacttgcagaacaaagactcaaggagagaatcttgagaagaagccagagccagctacttacatatgagaagcatgagagagtaaaagagataaaggagtttgaaagagttattgcgtatcttcttttccaaccatgcagtagaagtcggattaaagtgagtattcttatggataagtctcagaatggagagaaggtgaatacaattgtgaaaccatatcaaagaaaattcttggcaatgccaccctttttaagaagtcaaataggaaaaataagagattaaagtttcaatgctgttatgataaaatcatatctcttaagtgaacccttttttttttcaaatgctcgttctctccagggttcagtgaatattcccatttgtatcagatacagatagatagttctgcacttgaaaattagcttaacttttttagttgacttgcatttgttcaagttgcatatcctttctagtgttcagtgtcctcatctttaaaatggcaataatatttgatggcatttatggaaggactgttttttttgtgaagtgtaggtatgtattagttgtttcataaatgttagtttccccacttggaaagaccggggttgggcaatggtggtgaataaagaattgttctaatctacttctcttattctccctgttcccagccctccaaggttattttgatgagattgctatagtttagtatatggtctttaatatcataccttcatcagataactactagccagcccctaaaagtgtaacttgctctgtacaatttatttgaatgagaaacttaattttgagagcctcctacatgctaggcattatgttagttactgaaggtgaataaagagaagtctctgcccttgaataattttcaactaatggcatagatcactctataaacagataatgtagtaaataaaggttacaatagaaaggtacagggtgctttacaaaggacggattctaacctggcccaggtgagcagggtgaaaaggaggaaggttagggaagggagtattatagtctgtcatgtttcttccagctttttttgtcacttcctatcacccacttaagcaagaccttcctaatgcttggatccactcagggataatcaaactcagcctttctcaaactcatgtttttggcactcattgataaatcagaaagcaaatttataaatttagtgagaattacagttgtcaagcagaatgaaatttgtgttttctagtcagtttattttcttcccagataccagaaagttgggaaagcaggggttcagagttggtaagcagagaagcaaataaatggaaatagatgccctcaggaatattatgcttaagttgtgataattctgatgcccaccttgctttactagcagaacaccctttaccctggatactgctaggtcagccactgatacaaatgttctgtgtctgtgctcctcagtacagtagcccttgctacacgtggctgttgaggcatttaaaatgtggctggtgcagctgtggaatggaatgtttaattgaatttcatttaaatttaaattgccacatgtggcaagtgactaccctgttgcacagtgtagcactggataaacataacttctgtgttctagattccagtcccaccattagctttctgtttttgacagtgtttgctggtatgataggtcactgttcattttacattactatcagtttagtttcctttgcatttcagaggctccctaatcccttaaagagatttaaaaatcaatgtagaccacttctgtgtgaaaataagatgactgaatttgctttgattggaattaggaactgacctctctttgctagttctggaatttggccaggatgcacatcaaaatctcattcctaccctcctgatttgcctcatggaaacttcgttgctgtgtctgttctctggtcctctattgctatgtctcagctttagattctatgttttgcatagaaatggatcatcagaatgcaacaggcagaagacttagaagtgcaaatcagtagggtaatgacaagccctttgagctgagtgggactgaaaagtaacctaacatataacctattagtaattgtttaccatgaaggttttcagtgctggacacataaattgctgagttcaactgccctctttcccctccaaatctagcataaaagcaactggtgctctcagggcaatttcacacctaatacggctaagaataaaagtctatgtttcaggaactcagtttgtccaaacctgcatccatcatctacctcaaattatatccaccttttcatttctttgcactgtgtctgcttaaatcttgagtcacacttaatgttttttttttggtcttttttctttttaatgtgaaatagaatatacaatacacaaatgaaaatgtatatttagaagaacaataataaatgtccaggtgccngttgctcagactgagaaatggaacattactacatcccaggagcctcgtatgctctcattcatatctctctcccctgcagccagaggcaaccactatcctgaattttgtataactgtcacctagcttttatagattttactgtctgtgtatccctaacagttgcttatttatagcctttatataaatagaattatactgtatatgactgactacttttgctcattattatttttggattcatccatgttgatgtgtgacactgtagttcatttccatgacatgaatatgccacaacttaattatatattctgttgatgtcatttagttgtttccagtttttgttttatttttcttttaaaaatgatacttagataaacattaacatgtttaatcttatgttctggtgactgtgtactagatatatgtatgatatataaattgtggtacatttatttgacaggcctgatcttgaagcctgttagatttctgttcctttgtggcattatgcctgtaagcctgttctgtagagtctggcacatgttagcctcttaatagatatttgttgaaagaaaggacatttgttaactgctggagacaggcccaaaatacataaatagctgataacagaccactttagctttttactcatcttgtccaggtacaatcatagtcaacctctgtttatgcttatatttcagttgaggtactaaaatatttgtttacttagttggttttcagtgagcttccagtacaggatttgtttctctttctgtcacttttcccaaaactttcactccactgccttctagaaaagatcacccacatgtcntctcctcaaggcacctgcagcacgaaagttttatttctgaacaaaagggtccccagagaaggagacaaggagtctcctttcagtacgaggttgctggagtccctagagggtcaaaggctgtgtaataacagttccttcttgtctgctggacaaaagcttctgagccctcaagcaccctgtgacttagttctgatagagtactgagtttggaaatggcagagtggggacccaaaacaaatcttccaattccaaattcagttttatccaccttttcaaataagattaaaaaatgttaatgtctgttgatttgtgtgtgttgaaccactcttgtatccctgggatgaatcccaattaattgtggtatatttttgatatgttgttggattcagtttgctaaaattttgttcaggatttttgtgtatattttcactaggaagattggcctgtaattttctttttttttgtattcttctctgcttttggtatcagggcaatgcaggcttcataaaatgagttaagaataattccttcctcttcagttttttttaaatattttgagaagtattggtattaatttttctttgtatgtatggtagaatttgacaggaaagccatctggtcctgggcttttctttattgagacacttttaattactgattcagtcttattactcattgttggtctgttcaagttttctatttgttcctggtgaaatgtctacaaaaatnacaaaaattagctgggtgtggtggcatgtgcatgtagtcccagctacttagggggctgaggcaggaggatcgcttgaacctcaggaggttaaggctgcagtgagctggtattgcgccactgtgttgcagcctgggtgacaaagtgagaccctatctcaaaaataaaaaaaattcatatggaaccacaaaagagccccatccaatagttaagctatagtaatagctttgtaactgttatagtagaaaccaaatcatcatggtaccggcctaaaacagacacatagaccaatggaaagaatagagaacccagaaataatttcatatacttacagccaactgactttcaacaaaggcaccaagaaaggacacccttttcaataaatggtgctgggaaaactggatatccatatgcagaagattgcagctaggctcatatctcttaccatattaaaaaatcaaccaaaaatggattaaaggcttaaatgatagatccgaaactatgaaactactaaaagagaatataggggaaatgctcaagaacattggtctaggcaaagattttatggttaagacatcaaaagcataggcaacaacaacaaaaaataggcaggtgggactatattaaactaaaaatctgcacagcaaagaaaacaacagagtgaagagaccaactgtagatgggaacaatattttcaaattatccaacaggggactaatatccagagtgtacaaggaacacaattcaacagtaaa

SEQ ID NO: 287798 - DNA, 5863 bp, Homo sapiens
gccacagcgaatacaggtgaccgtatcctgagccccgggcagaggcaggaccgagccgcaatctgaacagaaatccaggtccgactgaaagctggagcaagtattggcgaggtccatgacagacatgcggtcgggtctgaggagggagttggaagtttattaacaaaagagagaagagttcctgtcccagaggtcgtaactattctgtcccaggacctaggagtatataacccgaaccctcctgccacgcacgcctcctgcctctgcgaccaaggagccgaaacgcccggaattcccagacagcgtcgggtactaaaggacttggaaccctttccaggggccggtgagaggagttaaccaactccgtgggctagagcgccagctctgcgcccgcggcggggcagcgagatagagccggctagagcgtcaggctttcgcgttgacgattggctgtgacgtcataattaattgcgaaccgtgtctcgggagcgttagagatggagactaacgtcttccaagggagattgcgtctccactttcaccctggtactgagaggttgagcacaaaattggtaaccaatgctgcgcttccagcaaattttcccaccagcacccaatcctgggatatttattctctttgtctcacatcctacaggaacgcagtcgcggggtatatccccctgaaaaccgtacgttgccaaataatgatttctttggattagagaactacaactcccctgggtcctgagccggtatttcccttttgcggctgcaccgtagttaaaaacaaagctaagtgttctgggacgtatagttctagcgttccttgggtcccgctggcgagcgtgggctttctgcagctcgcaaccggcctcgtgctttgcggacggttcactgcgcttggaaaggggtgagtcggctttttgagggacagcaagtggtgagagtgaaggcccgaggaatgcttagtcccacgggacgaaaggaagcagggatgaagtggtacacttgagaaggggttcaggactttggaggtggtggaacagaggagcttggggcttcctctccttcgactcctgccagataagtgaggctagcagtagtcaagaaagctcattaagtaggatttcataagacttaggtcgagtttggcttttagttgtgcctgccgcctatcgaactcttaattcattatgtcatccgttaagtggacagctgacatttccctgatcttttataaaacatgagaataagtatctttgggaaatctttctattttcattaatctgtaacttatattccaagtagaaactttccctgaaggggcagcttgtagttgtttactagtttcctgctagccctcccaccaccatccactctgatagctgtgctaagttcattcatataaaagttctggagccatcactgttttctcctatgaaggacacaagctgtagtcttttcgctgggagaggctcccatctgcctttctctgtaataatggagagaacgccatagtgaaagggttaaaactcagcaaactgctgaagagtgacaagccctatcacttaactgtgaaattgcttgttattctgtcttacaaagggagacgtgttgttgagctgattgtcgtagacagtttttattctcacttatctgtgtgtctcctttgaaaatggaacttgaaattctaccctcctcagttttctgtttttaatttgaaaaacagccaacatcccctgtgaattgcagtaaaggaacaaagcattaaaaggcatatccttttcccaacaaaagctcacagtctaatcagtaaagatttattgagcaactatgccaggttttgagctgaggctgagcctgcaaagttgaaatctgtgttctctgacctcaaggaacatgaatgaataattagaatataataaaactgtgctagtaggtacaaaatgtgagagcccagaacatgcatataaagcaaacatatctgtaaacttcaaggaagactgggaaatggcttaataaaaatagatacaatgttatggcagatatttaaaaaagatgctcagatattatgtgtcaaggatcatcagcaatcagcaaatcattaattttgagaacttgggatcacagactctaatgttaagtattgtgctagaagccatgtacagagaagtaaaagtaagatgatcatacgtttacaatctcaaaataagcttacgtagacaaataagaatgttcctaagaggtcagtgagaccaaatatttgatatcagatcctttccaacaatatagaggcatcatatttgtagatataaattacagttttcattccttatgagcctaaatttcagcatcaaaatgttaaaagtgatatgtgaatacagatatcacagtgtaaaccacgattaattttcaaatgagttgtagaattaaaatatgtcaagtatttagaggaagggaagatcactgacagagtagactggaaagactttataatcaggagcttgacctgtgaaggacagatagatagaatttattgagaacttaccaagctctttacatctaattcatatttgttctttataaccctgagaggcagatttttgtcttacatctccattttatagatgagaaagctgacagaagttacttgccctgagtcacacacctaggaagtggtagaattagatttcagatctagctctgtcagactgtaaagaccatcctttgaactctaaatggtataaaagacatacagaggaaatgccaggcatcctcagtggcttaaatacgacatcacagtaaactcaggctagaccagggatgacacataaaagatgatagttttcatttgtgttgccatcagcctcctctataaataaacccagagtaaccacaaattgccatcctgaggggttcaacagggaatagtctcataatggatttagagtgaaggatgattggcattgttagtcaggcaagcagagggctgagcagtcaaataacagaatttcagaacaaaagattagagggcagaaatgctgtatgtgctgatagagtcagagagggcccggatcaagaaactgcaggaagagaaaactagaaacctagaatcgtctagaaaactagaacctacaatcgtctcagaacacaaaggaggcttgaggactgagcagactgacatagatgtacttggacaacacctcaccaaggagcatgtctcttcccactcacaatccccaatacgagattcacagtggttcacgctgagtccacaggaaaaattggcctggggtacatcatctaaagatcctaggattgctgcaggtcagcagtctccactggaaaaaaagatcttgaatctaggtggtgtgcatacaacagcagcaagacagttgataatgcagaaatatcaggaggagtgtgaaatactctgtagggagcaagctgtttctcttgactactggcttgccaaagcagagtcttattataataaaataatagtggaaatgatgaaagaagagacaggcaatgaaatctagaaaaaaatggaggagaaaacaacccagagcgtagaaggactaaaacagtactgtttggtacctgagagagagatgaaacacatagaaaggcacatacatcaaacaggaaaggctggagaatttaagaacaaaccatttagacaagtactacaaccccccaatgaaacaaaattaccaaaaattatgccagaagggcatggcatccagaacgcacagagaagaaagcaggtaaatgagagggaacagatgcagactaaggatcaccaggaacgcatgattcgagggagagaacttgcagaacaaagactcaaggagagaatcttgagaagaagccagagccagctacttacatatgagaagcatgagagagtaaaagagataaaggagtttgaaagagttattgcgtatcttcttttccaaccatgcagtagaagtcggattaaacatgtatttcaagtcctctgatgaatcatgtgatctactagaccctgaagatacagtgaagagcaaaagaacacggatgaaatgagaaacaaaaacgatggagaaaaccaaaaaaggggacacatgggatccaggcaataggagagccagcataagagagaggcagagggatgcccaggatgaggtgaagacgatcttggaaatcagcccagatgtgcatgcaccagtccacgtgtggcaggaccaagggaagtgtcttcacaaagatgaggctttgatttgttggagaaactgttaccagaaaaacaggtcccgatcccgaccccaaaagagtattcttggatcttgcacaggaaggaattaaaggggtacactcctttggaaaccagaacctcgtatcctgcacagcccagtgttgggagataaaatatgcgaaataccccattgagtgaatctaagagattggacatggagccaaacctgcttccgccttttgatttctggacacacatgttcttcctattgagaacacagaactctagagacgtctctgattcaaacaatgcactgtgtcctgaaagatggcacccacccctcagagtgcttcctccaggctggcactgagttgtgcctgtagaagacctgtccagccttccttgtggctggcagctcctgggtagtgcagatggtgataggattagtggaacccacagccgtggaaacactgaaactttccctgcaaagtgggtccttcaggcagataatgggctaggagcactgcctagcctgcagaccaggaatgtcaacagcacccagagagtggtgctggctgtgtctgagagcaggacaggaaaacccacccatagaatcggtacctaaccctgtgaagatgaaactctggcccttccaggtggaagtagctaaatgtagtcaacttgttacttagtgggtagtcatgtaaagaaatagtgccccactagggcacatcatgggcctcaattgctgatgagttggacattcagaggtggcagcagctggatctgccttggtgtggggaagtcagtgctgctggccccttacggagcctcatgcctgccactgtggttgctccattcatgcactcatcctaccaggcctgggctgacccatggtgaaagctggctaactgccatttgtctgtttggtagttcagtgccacttcagacttgggtgttttctgtgggtgtcagcaagggattcaagctcaacccaggtggactgttttcacctgatgatgaatgctgttgggcctgtaccatctatgactttgtgggtcacacaggcacttggaaccccgtagttgcttggtatcccgtggtcaaacattctattgaatcaggacaaggaacactaaaagttgcttctaacagggggcatgtgtctctgctgtggatgacatgatcttactccagaatcccaggccctccactgtgactctcccactggtgcttggttcagctccatcctgtgtctttccccaccactggcaccaccagccccaggggtctgagggatggtggctgcttgtaccatggcctggatctgctgcagggtcctttcctgtgtaggccccacttgaagctggcatcctcctatgtcacctagactgtgggccaaagcaaaatgtctagatgtggaatgtggtgttgttataattcaaagaggctcaccaagcagtgtgcttccttgcttctggtgaggatgcaagatgcaacagtttttcttttaccttggaggggacacacctgcattcccctaaacacttggcacttgttcacccataaaacttcacttcagtgcccacctttgaagctgtataaggtttatcttcaccttgt

SEQ ID NO: 287799 - DNA, 2497 bp, Homo sapiens
gccacagcgaatacaggtgaccgtatcctgagccccgggcagaggcaggaccgagccgcaatctgaacagaaatccaggtccgactgaaagctggagcaagtattggcgaggtccatgacagacatgcggtcgggtctgaggagggagttggaagtttattaacaaaagagagaagagttcctgtcccagaggtcgtaactattctgtcccaggacctaggagtatataacccgaaccctcctgccacgcacgcctcctgcctctgcgaccaaggagccgaaacgcccggaattcccagacagcgtcgggtactaaaggacttggaaccctttccaggggccggtgagaggagttaaccaactccgtgggctagagcgccagctctgcgcccgcggcggggcagcgagatagagccggctagagcgtcaggctttcgcgttgacgattggctgtgacgtcataattaattgcgaaccgtgtctcgggagcgttagagatggagactaacgtcttccaagggagattgcgtctccactttcaccctggtactgagaggttgagcacaaaattggtaaccaatgctgcgcttccagcaaattttcccaccagcacccaatcctgggatatttattctctttgtctcacatcctacaggaacgcagtcgcggggtatatccccctgaaaaccgtacgttgccaaataatgatttctttggattagagaactacaactcccctgggtcctgagccggtatttcccttttgcggctgcaccgtagttaaaaacaaagctaagtgttctgggacgtatagttctagcgttccttgggtcccgctggcgagcgtgggctttctgcagctcgcaaccggcctcgtgctttgcggacggttcactgcgcttggaaagggattggcctggggtacatcatctaaagatcctaggattgctgcaggtcagcagtctccactggaaaaaaagatcttggggtacactcctttggaaaccagaacctcgtatcctgcacagcccagtgttgggagataaaatatgcgaaataccccattgagtgaatctaagagattggacatggagccaaacctgcttccgccttttgatttctggacacacatgttcttcctattgagaacacagaactctagagacgtctctgattcaaacaatgcactgtgtcctgaaagatggcacccacccctcagagtgcttcctccaggctggcactgagttgtgcctgtagaagacctgtccagccttccttgtggctggcagctcctgggtagtgcagatggtgataggattagtggaacccacagccgtggaaacactgaaactttccctgcaaagtgggtccttcaggcagataatgggctaggagcactgcctagcctgcagaccaggaatgtcaacagcacccagagagtggtgctggctgtgtctgagagcaggacaggaaaacccacccatagaatcggtacctaaccctgtgaagatgaaactctggcccttccaggtggaagtagctaaatgtagtcaacttgttacttagtgggtagtcatgtaaagaaatagtgccccactagggcacatcatgggcctcaattgctgatgagttggacattcagaggtggcagcagctggatctgccttggtgtggggaagtcagtgctgctggccccttacggagcctcatgcctgccactgtggttgctccattcatgcactcatcctaccaggcctgggctgacccatggtgaaagctggctaactgccatttgtctgtttggtagttcagtgccacttcagacttgggtgttttctgtgggtgtcagcaagggattcaagctcaacccaggtggactgttttcacctgatgatgaatgctgttgggcctgtaccatctatgactttgtgggtcacacaggcacttggaaccccgtagttgcttggtatcccgtggtcaaacattctattgaatcaggacaaggaacactaaaagttgcttctaacagggggcatgtgtctctgctgtggatgacatgatcttactccagaatcccaggccctccactgtgactctcccactggtgcttggttcagctccatcctgtgtctttccccaccactggcaccaccagccccaggggtctgagggatggtggctgcttgtaccatggcctggatctgctgcagggtcctttcctgtgtaggccccacttgaagctggcatcctcctatgtcacctagactgtgggccaaagcaaaatgtctagatgtggaatgtggtgttgttataattcaaagaggctcaccaagcagtgtgcttccttgcttctggtgaggatgcaagatgcaacagtttttcttttaccttggaggggacacacctgcattcccctaaacacttggcacttgttcacccataaaacttcacttcagtgcccacctttgaagctgtataaggtttatcttcaccttgt

SEQ ID NO: 287800 - DNA, 2780 bp, Homo sapiens
gccacagcgaatacaggtgaccgtatcctgagccccgggcagaggcaggaccgagccgcaatctgaacagaaatccaggtccgactgaaagctggagcaagtattggcgaggtccatgacagacatgcggtcgggtctgaggagggagttggaagtttattaacaaaagagagaagagttcctgtcccagaggtcgtaactattctgtcccaggacctaggagtatataacccgaaccctcctgccacgcacgcctcctgcctctgcgaccaaggagccgaaacgcccggaattcccagacagcgtcgggtactaaaggacttggaaccctttccaggggccggtgagaggagttaaccaactccgtgggctagagcgccagctctgcgcccgcggcggggcagcgagatagagccggctagagcgtcaggctttcgcgttgacgattggctgtgacgtcataattaattgcgaaccgtgtctcgggagcgttagagatggagactaacgtcttccaagggagattgcgtctccactttcaccctggtactgagaggttgagcacaaaattggaacgcagtcgcggggtatatccccctgaaaaccgtacgttgccaaataatgatttctttggattagagaactacaactcccctgggtcctgagccggtatttcccttttgcggctgcaccgtagttaaaaacaaagctaagtgttctgggacgtatagttctagcgttccttgggtcccgctggcgagcgtgggctttctgcagctcgcaaccggcctcgtgctttgcggacggttcactgcgcttggaaagggattggcctggggtacatcatctaaagatcctaggattgctgcaggtcagcagtctccactggaaaaaaagatcttgcatgtatttcaagtcctctgatgaatcatgtgatctactagaccctgaagatacagtgaagagcaaaagaacacggatgaaatgagaaacaaaaacgatggagaaaaccaaaaaaggggacacatgggatccaggcaataggagagccagcataagagagaggcagagggatgcccaggatgaggtgaagacgatcttggaaatcagcccagatgtgcatgcaccagtccacgtgtggcaggaccaagggaagtgtcttcacaaagatgaggctttgatttgttggagaaactgttaccagaaaaacaggtcccgatcccgaccccaaaagagtattcttggatcttgcacaggaaggaattaaaggggtacactcctttggaaaccagaacctcgtatcctgcacagcccagtgttgggagataaaatatgcgaaataccccattgagtgaatctaagagattggacatggagccaaacctgcttccgccttttgatttctggacacacatgttcttcctattgagaacacagaactctagagacgtctctgattcaaacaatgcactgtgtcctgaaagatggcacccacccctcagagtgcttcctccaggctggcactgagttgtgcctgtagaagacctgtccagccttccttgtggctggcagctcctgggtagtgcagatggtgataggattagtggaacccacagccgtggaaacactgaaactttccctgcaaagtgggtccttcaggcagataatgggctaggagcactgcctagcctgcagaccaggaatgtcaacagcacccagagagtggtgctggctgtgtctgagagcaggacaggaaaacccacccatagaatcggtacctaaccctgtgaagatgaaactctggcccttccaggtggaagtagctaaatgtagtcaacttgttacttagtgggtagtcatgtaaagaaatagtgccccactagggcacatcatgggcctcaattgctgatgagttggacattcagaggtggcagcagctggatctgccttggtgtggggaagtcagtgctgctggccccttacggagcctcatgcctgccactgtggttgctccattcatgcactcatcctaccaggcctgggctgacccatggtgaaagctggctaactgccatttgtctgtttggtagttcagtgccacttcagacttgggtgttttctgtgggtgtcagcaagggattcaagctcaacccaggtggactgttttcacctgatgatgaatgctgttgggcctgtaccatctatgactttgtgggtcacacaggcacttggaaccccgtagttgcttggtatcccgtggtcaaacattctattgaatcaggacaaggaacactaaaagttgcttctaacagggggcatgtgtctctgctgtggatgacatgatcttactccagaatcccaggccctccactgtgactctcccactggtgcttggttcagctccatcctgtgtctttccccaccactggcaccaccagccccaggggtctgagggatggtggctgcttgtaccatggcctggatctgctgcagggtcctttcctgtgtaggccccacttgaagctggcatcctcctatgtcacctagactgtgggccaaagcaaaatgtctagatgtggaatgtggtgttgttataattcaaagaggctcaccaagcagtgtgcttccttgcttctggtgaggatgcaagatgcaacagtttttcttttaccttggaggggacacacctgcattcccctaaacacttggcacttgttcacccataaaacttcacttcagtgcccacctttgaagctgtataaggtttatcttcaccttgt

SEQ ID NO: 287801 - DNA, 645 bp, Homo sapiens
gtaagtaaattatcttcacatcatacagtttggaactacacagagaaggaatcttaggtttaaaatccttctgcccaagtgacacattcaggtagtatgtctacactggcaaatgttacccagctatatccacagttgcaaaacaaagtatcatttttggaaacttccaacaccatacatttttaaacctagttactgatttgtggtggtgagtacttaatactttcagagctcccaggctcacctgggagtgatgggaataaaataacaactaagctaaagtaaagagcatgtagcttttcctggtgtcattagggagggtgggcttggctcctgtttaaatgtgttcaaaggaaaaagatgatcacattataaatttctgacttcattttgacagaatctaggtggtgtgcatacaacagcagcaagacagttgataatgcagaaatatcaggaggagtgtgaaatactctgtagggagcaagctgtttctcttgactactggcttgccaaagcagagtcttattataataaaataatagtggaaatgatgaaagaagagacaggcaatgaaatctagaaaaaaatggaggagaaaacaacccagagcgtagaaggactaaaacagtactgtttggtacctga

SEQ ID NO: 287802 - DNA, 1890 bp, Homo sapiens
tgtgggggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagcctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 287803 - DNA, 2193 bp, Homo sapiens
tgtgggggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagtgagtgtgtggcactggtggcctggagccaaatttagcttgggtgagagttgacaatggtagttttccttcctcaagcccctctgtgcccctagagcaccctggctgtggctgcctccttcatccaagagcagagtccatgttgggccaggagacttcagatccatgtcctggtgctgcctctggctttgtctttcctcagtgggcaggactgggtctgctggtccatctttacccttctctgagctatgcagccttggcctgctgcgtctccggcctgtattctctccccttcactcaggcgcctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 287804 - DNA, 1101 bp, Homo sapiens
  misc_feature (1093)..(1093): n is a, c, g, or t
tgtgggggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatactggacagcatttgagaagaagagtatgttgttgtctgagaagagtgtgttgagagatgagtactaagatgatgaagaaaagtgaagagtattatatgagaagaaagacaagtaaagtagaaaatagagagatcangattagta

SEQ ID NO: 287805 - DNA, 2105 bp, Homo sapiens
tgtgggggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagtgagtgtgtggcactggtggcctggagccaaatttagcttgggtgagagttgacaatggtagttttccttcctcaagcccctctgtgcccctagagcaccctggctgtggctgcctccttcatccaagagcagagtccatctttacccttctctgagctatgcagccttggcctgctgcgtctccggcctgtattctctccccttcactcaggcgcctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 287806 - DNA, 2115 bp, Homo sapiens
tgtgggggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatacccctctgtgcccctagagcaccctggctgtggctgcctccttcatccaagagcagagtccatgttgggccaggagacttcagatccatgtcctggtgctgcctctggctttgtctttcctcagtgggcaggactgggtctgctggtccatctttacccttctctgagctatgcagccttggcctgctgcgtctccggcctgtattctctccccttcactcaggcgcctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 287807 - DNA, 2139 bp, Homo sapiens
tgtgggggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagtgagtgtgtggcactggtggcctggagccaaatttagcttgggtgagagttgacaatggtagttttccttcctcaagcccctctgtgcccctagagcaccctggctgtggctgcctccttcatccaagagcagagtccatgttgggccaggagacttcagatccatgtcctggtgctgcctctggctttgtctttcctcagtgggcaggactgggtctgctggtccatctttacccttctctgagctatgcagccttggcctgctgcgtctccggcctgtattctctccccttcactcaggcgcctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 287808 - DNA, 2032 bp, Homo sapiens
tgtgggggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagtgagtgtgtggcactggtggcctggagccaaatttagcttgggtgagagttgacaatggtagttttccttcctcaagcccctctgtgcccctagagcaccctggctgtggctgcctccttcatccaagagcagagtccatgttgggccaggagacttcagatccatgtcctggtgctgcctctggctttgtctttcctcagtgggcaggactgggtctgctggtccatctttacccttctctgagctatgcagccttggcctgctgcgtctccggcctgtattctctccccttcactcaggcgcctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 287809 - DNA, 2859 bp, Homo sapiens
tgtgggggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaagtaaggttgggttttcccctgctggcctttggggaaagctctccccgctatgacagataggaggtgatgctgagtcagggttgcacccctctcggtggggtcaaggacagcgagcaactctggtcagtgggtctacaaggaatttctgcttgctttctacagggggcctctttccttggtccctcggtgtctcccagggccccatatccttagactatagggctggaggttgtaaaggggtgtggtgtggtggccaaaacttgttgagaggggccaggtttcaggatcagctggccaattcaaactgacctgggagcctgattgcagaaaacaagttcaccagagtaagaagagggtttgggaagacggagcagaacaagcagcgaagaggtatttaagtgggcagctggtgggcgggcagctataggggcctgggactgccaggcagaggaacaggaaggtaagcaaggagggctgtaggcgataaggcctcgcgtgctaggtcgtcttctttctctgaaggccactcagggtggacccatgcagcccactgtccaggccctggcaacgctgagtagcagccggtgggcctggaatacgctgagagccagctggcccctgatctccaggtgacagcctcagaacctgttactactctgcccacagacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagtgagtgtgtggcactggtggcctggagccaaatttagcttgggtgagagttgacaatggtagttttccttcctcaagcccctctgtgcccctagagcaccctggctgtggctgcctccttcatccaagagcagagtccatgttgggccaggagacttcagatccatgtcctggtgctgcctctggctttgtctttcctcagtgggcaggactgggtctgctggtccatctttacccttctctgagctatgcagccttggcctgctgcgtctccggcctgtattctctccccttcactcaggcgcctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 287810 - DNA, 2998 bp, Homo sapiens
tgtgggggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccagggtaagtacccagcccactgaccccaaagggccctggctgcctcggggaggggggttgaggtctagctctgctctggagcccaccttgaggaaatctcaaggcagacggacagactggttgcttggtgctttgccgatagtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaagtaaggttgggttttcccctgctggcctttggggaaagctctccccgctatgacagataggaggtgatgctgagtcagggttgcacccctctcggtggggtcaaggacagcgagcaactctggtcagtgggtctacaaggaatttctgcttgctttctacagggggcctctttccttggtccctcggtgtctcccagggccccatatccttagactatagggctggaggttgtaaaggggtgtggtgtggtggccaaaacttgttgagaggggccaggtttcaggatcagctggccaattcaaactgacctgggagcctgattgcagaaaacaagttcaccagagtaagaagagggtttgggaagacggagcagaacaagcagcgaagaggtatttaagtgggcagctggtgggcgggcagctataggggcctgggactgccaggcagaggaacaggaaggtaagcaaggagggctgtaggcgataaggcctcgcgtgctaggtcgtcttctttctctgaaggccactcagggtggacccatgcagcccactgtccaggccctggcaacgctgagtagcagccggtgggcctggaatacgctgagagccagctggcccctgatctccaggtgacagcctcagaacctgttactactctgcccacagacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagtgagtgtgtggcactggtggcctggagccaaatttagcttgggtgagagttgacaatggtagttttccttcctcaagcccctctgtgcccctagagcaccctggctgtggctgcctccttcatccaagagcagagtccatgttgggccaggagacttcagatccatgtcctggtgctgcctctggctttgtctttcctcagtgggcaggactgggtctgctggtccatctttacccttctctgagctatgcagccttggcctgctgcgtctccggcctgtattctctccccttcactcaggcgcctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 287811 - DNA, 1929 bp, Homo sapiens
tgtgggggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccagggcagacggacagactggttgcttggtgctttgccgatagtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagcctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 287812 - DNA, 1777 bp, Homo sapiens
  misc_feature (15)..(15): n is a, c, g, or t
  misc_feature (19)..(19): n is a, c, g, or t
  misc_feature (26)..(26): n is a, c, g, or t
ggggaataacaagancggnacccagncgtcaaacacctcggcgggacggaagccccccggtacgtagtctgctgagagcgtgtgtacgactcagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagcctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 287813 - DNA, 2150 bp, Homo sapiens
tgtgggggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagtgagtgtgtggcactggtggcctggagccaaatttagcttgggtgagagttgacaatggtagttttccttcctcaagcccctctgtgcccctagagcaccctggctgtggctgcctccttcatccaagagcagagtccatgttgggccaggagacttcagatccatgtcctggtgctgcctctggctttgtctttcctcagtgggcaggactgggtctgctggtccatctttacccttctctgagctatgcagccttggcctgctgcgtctccggcctgtattctctccccttcactcaggcgcctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtcccaccgtaactcgtggggggcgccaagcagtaaatgtttc

SEQ ID NO: 287814 - DNA, 1871 bp, Homo sapiens
tgtgggggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagcctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 287815 - DNA, 1891 bp, Homo sapiens
  misc_feature (1531)..(1532): n is a, c, g, or t
  misc_feature (1535)..(1535): n is a, c, g, or t
tgtgggggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagcctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaaaataccaaataaaaaaaaaaannatnaaaatggagaaaaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 287816 - DNA, 2219 bp, Homo sapiens
tgtgggggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagtgagtgtgtggcactggtggcctggagccaaatttagcttgggtgagagttgacaatggtagttttccttcctcaagcccctctgtgcccctagagcaccctggctgtggctgcctccttcatccaagagcagagtccatgttgggccaggagacttcagatccatgtcctggtgctgcctctggctttgtctttcctcagtgggcaggactgggtctgctggtccatctttacccttctctgagctatgcagccttggcctgctgcgtctccggcctgtattctctccccttcactcaggcgcctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctgctctatccccaccttcttgacacctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 287817 - DNA, 1973 bp, Homo sapiens
tgtgggggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagcctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggtgagaaggcggaaggtgtgggggtgctggctgggggagttttggtgctgattctgcctgtcccttctcttcctccactgcaggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 287818 - DNA, 1756 bp, Homo sapiens
tgtgggggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccccagaatcttccatcctgatgcctgagtcggtagtgaagccagtgccagcaccgcaggcggtccaaccctccagacaagagagcagttgcggcagcctggagctgcaacttcctgagctcgagccccccacaaccctggctccaggtctgctggcccctggcaggaggaaacagaggctgagactgtcagtgtttcagcagggagtggaccaggggctgtctctctcccaagagcctcaagggaatgctgatgcctcttccctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagcctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagttctatgccaagatgcccatggagaggaaggctcttgagattgtggagaagtgcctagataaatatttccagcatctttgtgatgatctggaggtatttgctgctcatgctggccgcaagactgtgaagccagcaggtggtcagggctgctggtcctggctggccaagggccacgtggtccccagcctcagcagaagccagcaagacttgctcttgaataagagcctccttgaggcaagttcagccccctctgtccactgttgccctcagcttatcttcagagcctgcagagcctctgttggtcaggcatccccctaggccccggaccaccggccccaggccccggcaagatccccaccatcaataaagtgtcataaacagaa

SEQ ID NO: 287819 - DNA, 982 bp, Homo sapiens
  misc_feature (29)..(29): n is a, c, g, or t
gtgtagacgtggtgccttttgcggatctncagatacttcctgctcctccaaacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagcctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 287820 - DNA, 825 bp, Homo sapiens
agctgtgttcaggccctagcacacagaaaggccttgtctgggttgtgtttccgggcactggtggtggtagggggtcagggagacactgaggggcacctgcttggctggagctaggtggggcccaccagaaacaggacagaaatactgtggctgtgctggcctgggtgagatggtcaggcctggaatccctgtgaccccacccttcttctttgtagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 287821 - DNA, 1082 bp, Homo sapiens
accccattcctcatgggcctcttgggaagggagcattgggtatgctgtgtacatagggtcctcccccttcctacgggtatgcagatgattacccagcagggcagcttcagctgggctggggagagctcaccaagagcacccctgccatcctggtgcctgcctccacggcttagaggagcctgggtgaggggaaagtatgtggttggtttgtagtcagaaaaggcttcctggaagacgattagcagaatcgggaaaggcagcagtagagtaaggagagagactatccattctaaggcctggagtcatggacccaagcaggtaccaatatagataataagtctgaaccaggatgtcgagtcgactgtggagggacagagccccagggaaagactggcctctatgtggccccctgacccaactgcccctcagcaggtggtcagggctgctggtcctggctggccaagggccacgtggtccccagcctcagcagaagccagcaagacttgctcttgaataagagcctccttgaggcaagttcagccccctctgtccactgttgccctcagcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 287822 - DNA, 1021 bp, Homo sapiens
  misc_feature (30)..(30): n is a, c, g, or t
gccacgagctcgtgccgaattcggcagagntatgaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagttctatgccaagatgcccatggagaggaaggctcttgagattgtggagaagtgcctagataaatatttccagcatctttgtgatgatctggaggtatttgctgctcatgctggccgcaagactgtgaagccagcaggtggtcagggctgctggtcctggctggccaagggccacgtggtccccagcctcagcagaagccagcaagacttgctcttgaataagagcctccttgaggcaagttcagccccctctgtccactgttgccctcagcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 287823 - DNA, 1197 bp, Homo sapiens
  misc_feature (153)..(153): n is a, c, g, or t
  misc_feature (158)..(158): n is a, c, g, or t
  misc_feature (210)..(210): n is a, c, g, or t
  misc_feature (240)..(240): n is a, c, g, or t
  misc_feature (259)..(259): n is a, c, g, or t
  misc_feature (261)..(261): n is a, c, g, or t
atacatatactatatatacacaacaaacatcatatatcacactactacattctaaaatatattaaatacacttttcaactagattacttctacatctactactcacttacaatataatctctcccactcacccactactgtctttcgattcantctcntcctcacatttgaaacacgcttaccatgtgtccactatatcctccctcaccntcacactgggctaaacgctagcagctccgntcgcagacacagacagtgncntggctcagaaaataccctgaaagcctgggaaaccagcccagtttctggcaggagaggcagaggaggtcaatgcctttgctctgggcttcctgagcaccagcagtggtgtctctggagaagatgaagtagagcccttacacgatggagttgaagaggcagagaaaaagatggaagaagaaggtgtgagtgtgagtgaaatggaggcaacaggagcacaaggacccagcagggtagaagaggctgagggacacacagaggtgacagaagcagagggatcccaggggactgctgaggctgacgggccaggagcatcttcaggggatgaggatgcctctggcagggcagcaagtccagagtcggcctccagcacccctgagtctctccaggccaggcgacatcatcagtttcttgagccagccccagcgcctggtgctgcagtcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcatctttgtgatgatctggaggtatttgctgctcatgctggccgcaagactgtgaagccagaggacctggagctgctgatgcggcggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 287824 - DNA, 1165 bp, Homo sapiens
accccattcctcatgggcctcttgggaagggagcattgggtatgctgtgtacatagggtcctcccccttcctacgggtatgcagatgattacccagcagggcagcttcagctgggctggggagagctcaccaagagcacccctgccatcctggtgcctgcctccacggcttagaggagcctgggtgaggggaaagtatgtggttggtttgtagtcagaaaaggcttcctggaagacgattagcagaatcgggaaaggcagcagtagagtaaggagagagactatccattctaaggcctggagtcatggacccaagcaggtaccaatatagataataagtctgaaccaggatgtcgagtcgactgtggagggacagagccccagggaaagactggcctctatgtggccccctgacccaactgcccctcagcaggtggtcagggctgctggtcctggctggccaagggccacgtggtccccagcctcagcagaagccagcaagacttgctcttgaataagagcctccttgaggcaagttcagccccctctgtccactgttgccctcagcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtgcctagataaatatttccagcatctttgtgatgatctggaggtatttgctgctcatgctggccgcaagactgtgaagccagaggacctggagctgctgatgcggcggtgagaaggcggaaggtgtgggggtgctggctgggggagttttggtgctgattctgcctgtcccttctcttcctccactgcaggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaa

SEQ ID NO: 287825 - DNA, 680 bp, Homo sapiens
tgtgggggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctggagcccggagagccctgcttgaaacggcttcccccaggaagttgagtggccaaacaaggacgatagccagagggcgttcccatggagccaggtctgttggcagatcggcccatattcaggccagtgggcacttggaggaacagacacctcggacgctgctgaagaacatcctactaactgccatctcccaggcagtcgctattctaccccctttacccaagatccccactccaagcatctcccctgtggctgcatgtgctccactggtggtcctccctaggtatgtaggtgggagtactagaggagacagtctggcactgcactgagctttaacctaaggctccacccgggggataccaatcttatatcccctttccatctccctgccttccggctggacttgccaatgttcctgctgctgaccccgccttcactctgtggatctctctctctctctctctctctctctgtcgtat

SEQ ID NO: 287826 - DNA, 651 bp, Homo sapiens
tggagattgagttgtaacccaacccattgacttcatcacagctttcttccatgtagaataacgaatttcactttctagaattagaaggtagaaaaaacacataacgaaaggtagtttgctgagatgttcttagtaccatacttatgatcactcaacattcttgacaaattattgcacacattaaactgcagtagggctttagcaggactcagatttgaaagcacatggttgctgatgactgccagtgactggaagacatgcttgcttggaagttggagtgaaacaggacacagggaggctgggtgtagtggctcatgcctgtaatcccagcattttgggagggtgaggagggaggatggcttgacctcaggagtttgagaccagcttgagcaatgtggtaaaaccctgcctgtagtaccagctacctgggaggctgaagcaggaggatcatttgagcctgggagccagtaaatgagggctctactcttggttagttagttagtattaatctactagcaggctgttgaaacctctcaatacatcacattatttctctacaaaatggagattgggctacgtgattgctcaagttcattagtactttgctattattgccattattaagaaatgactaatatattcttccaatag

SEQ ID NO: 287827 - DNA, 2896 bp, Homo sapiens
agcagccggcacggggacagccggccgcacaacggatctgcaggcgcggagcaaaatgcacccgccgcgccgcgcggtcctgcagccccgccacggccccgcggcccgcacccccccggggcgacagtgagcctctcccgccaccaccgggggccgagcggagggctctcgggtgggagagcgggaccagatctcgacagctgttcatttccaggaagccaccgcagccagagcgaaaggggaccttctgccaccagcggggcatcagccagcggcgcgcatggatttatgaagacactcatgcaagaagtgggcaggacttggacaaacttttccaccggctccgcgtccgccgctccccgcgcctcgtctcctttcccctcctctcccggcggccgccgctgcccgcgatggtggccgcgctgctgggcggcggcggcgaggcccgcggggggacagtgccgggcgcctggctgtgcctgatggcgctgctgcagctgctgggctcggcgccgcggggatcggggctggcgcacggccgccgcctcatctgctggcaggcgctgctgcagtgccagggggagccggagtgcagctacgcctacaaccagtacgccgaggcgtgcgcgccggtgctggcgcagcacggcgggggcgacgcgcccggggccgccgccgccgctttcccggcctcggccgcctctttctcgtcgcgctggcgctgcccgagtcactgcatctcggccctcattcagctcaaccacacgcgccgcgggcccgccctggaggactgtgactgcgcgcaggacgagaactgcaagtccaccaagcgcgccattgagccgtgcctgccccggacgagcggcggcggcgcgggcggccccggcgcgggcggggtcatgggctgcaccgaggcccggcggcgctgcgaccgcgacagccgctgcaacctggcgctgagccgctacctgacctactgcggcaaagtcttcaacgggctgcgctgcacggacgaatgccgcaccgtcattgaggacatgctggctatgcccaaggtggcgctgctcaacgactgcgtgtgcgacggcctcgagcggcccatctgcgagtcggtcaaggagaacatggcccgcctgtgcttcggcgccgagctgggcaacggccccggcagcagcggctcggacgggggcctggacgactactacgatgaggactacgatgacgagcagcgcaccgggggcgcgggtggtgagcagccgctggacgacgacgacggcgtcccgcacccaccgcgcccgggcagcggcgctgctgcatcgggcggccgcggggacctgccctatgggcctgggcgcaggagcagcggcggcggcggccgcttggcgccccggggcgcctggaccccactcgcctccatcttgctgctgctgcttgggccgctcttttagccctcgcgccccccgccgttggctgcgggagagcccgcgtcccactcccgtgctcgcctcgaccccgcgccgggcacctgtggcttgggacagatagaagggatggttggggatacttcccaaaactttttccaagtcaacttggtgtagccggttccccggccacgactctgggcacttcccctgaagctcctctccggagcttgacttcttggacctcctcccccgccccaattccaagctccagaaactcccaactcgtctgccgtccagaaagctagctgcagtgttcaggacgtccgggaggaagcaagcatgtgggggacagaacagtagtcctggactcgaaagggaaggtgctgaccagtggggccttagcaatttgaagggttgggaaggaggaattatatttgcaaaggggctgtctattagcatatttcctttgagggggcaaaaaaaagtgccagtatcgacttttacagattgtggccagtgaggatattataatcctatgtaaacagaaaagtcccacttaccgattcattctttcactgtttgtatctgcgcccagaattctcagtgacgtgggggtgagggtgggtggcgattgccttagagggaacccctaaattggttttggataagtttgagcccttgaccttaatttcattgctaccactctgatctcttagcacatttcttaggattaagggtccaaaaatgctgatctaaggggttgccatggtgttgaacaatgcaactttttatttaaaaaagctctgcactgccatgtatgaaagtctctttatgatgtttgtttttttgtcatttttgttctttacatcaagaaattttatgtttaaatatgcggagaatgtatattgcctctgctcctatcagggttgctaaaccctggtacatcgtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgtcatcaggaatcaaaacccacagtccattgtgaagtgtgctatatttagaacagtcttaaaatgtacagtgtattttatagaattgaagttaacattcttattttcaagagaatttatggacgttgtagaaatgtacaaatgcatttccaaactgccttaaacgttgtatttttatagacatgttttttaaaaatcctaagtttttaaataactatggatttgtgtattttttttggttatttgttttattaaaacatgtacatcagtaaagagttttaaacaatgaaaacacatagtaaaaagaataaaaaaaaaatttgggggcttgggctagaaagttatacaacttgttggg

SEQ ID NO: 287828 - DNA, 2844 bp, Homo sapiens
agcagccggcacggggacagccggccgcacaacggatctgcaggcgcggagcaaaatgcacccgccgcgccgcgcggtcctgcagccccgccacggccccgcggcccgcacccccccggggcgacagtgagcctctcccgccaccaccgggggccgagcggagggctctcgggtgggagagcgggaccagatctcgacagctgttcatttccaggaagccaccgcagccagagcgaaaggggaccttctgccaccagcggggcatcagccagcggcgcgcatggatttatgaagacactcatgcaagaagtgggcaggacttggacaaacttttccaccggctccgcgtccgccgctccccgcgcctcgtctcctttcccctcctctcccggcggccgccgctgcccgcgatggtggccgcgctgctgggcggcggcggcgaggcccgcggggggacagtgccgggcgcctggctgtgcctgatggcgctgctgcagctgctgggctcggcgccgcggggatcggggctggcgcacggccgccgcctcatctgctggcaggcgctgctgcagtgccagggggagccggagtgcagctacgcctacaaccagtacgccgaggcgtgcgcgccggtgctggcgcagcacggcgggggcgacgcgcccggggccgccgccgccgctttcccggcctcggccgcctctttctcgtcgcgctggcgctgcccgagtcactgcatctcggccctcattcagctcaaccacacgcgccgcgggcccgccctggaggactgtgactgcgcgcaggacgagaactgcaagtccaccaagcgcgccattgagccgtgcctgccccggacgagcggcggcggcgcgggcggccccggcgcgggcggggtcatgggctgcaccgaggcccggcggcgctgcgaccgcgacagccgctgcaacctggcgctgagccgctacctgacctactgcggcaaagtcttcaacgggctgcgctgcacggacgaatgccgcaccgtcattgaggacatgctggctatgcccaaggtggcgctgctcaacgactgcgtgtgcgacggcctcgagcggcccatctgcgagtcggtcaaggagaacatggcccgcctgtgcttcggcgccgagctgggcaacggccccggcagcagcggctcggacgggggcctggacgactactacgatgaggactacgatgacgagcagcgcaccgggggcgcgggtggtgagcagccgctggacgacgacgacggcgtcccgcacccaccgcgcccgggcagcggcgctgctgcatcgggcggccgcggggacctgccctatgggcctgggcgcaggagcagcggcggcggcggccgcttggcgccccggggcgcctggaccccactcgcctccatcttgctgctgctgcttgggccgctcttttagccctcgcgccccccgcgccgggcacctgtggcttgggacagatagaagggatggttggggatacttcccaaaactttttccaagtcaacttggtgtagccggttccccggccacgactctgggcacttcccctgaagctcctctccggagcttgacttcttggacctcctcccccgccccaattccaagctccagaaactcccaactcgtctgccgtccagaaagctagctgcagtgttcaggacgtccgggaggaagcaagcatgtgggggacagaacagtagtcctggactcgaaagggaaggtgctgaccagtggggccttagcaatttgaagggttgggaaggaggaattatatttgcaaaggggctgtctattagcatatttcctttgagggggcaaaaaaaagtgccagtatcgacttttacagattgtggccagtgaggatattataatcctatgtaaacagaaaagtcccacttaccgattcattctttcactgtttgtatctgcgcccagaattctcagtgacgtgggggtgagggtgggtggcgattgccttagagggaacccctaaattggttttggataagtttgagcccttgaccttaatttcattgctaccactctgatctcttagcacatttcttaggattaagggtccaaaaatgctgatctaaggggttgccatggtgttgaacaatgcaactttttatttaaaaaagctctgcactgccatgtatgaaagtctctttatgatgtttgtttttttgtcatttttgttctttacatcaagaaattttatgtttaaatatgcggagaatgtatattgcctctgctcctatcagggttgctaaaccctggtacatcgtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgtcatcaggaatcaaaacccacagtccattgtgaagtgtgctatatttagaacagtcttaaaatgtacagtgtattttatagaattgaagttaacattcttattttcaagagaatttatggacgttgtagaaatgtacaaatgcatttccaaactgccttaaacgttgtatttttatagacatgttttttaaaaatcctaagtttttaaataactatggatttgtgtattttttttggttatttgttttattaaaacatgtacatcagtaaagagttttaaacaatgaaaacacatagtaaaaagaataaaaaaaaaatttgggggcttgggctagaaagttatacaacttgttggg

SEQ ID NO: 287829 - DNA, 1004 bp, Homo sapiens
gatccctggtcatcttgtctacatatcgacttttacagattgtggccagtgaggatattataatcctatgtaaacagaaaagtcccacttaccgattcattctttcactgtttgtatctgcgcccagaattctcagtgacgtgggggtgagggtgggtggcgattgccttagagggaacccctaaattggttttggataagtttgagcccttgaccttaatttcattgctaccactctgatctcttagcacatttcttaggattaagggtccaaaaatgctgatctaaggggttgccatggtgttgaacaatgcaactttttatttaaaaaagctctgcactgccatgtatgaaagtctctttatgatgtttgtttttttgtcatttttgttctttacatcaagaaattttatgtttaaatatgcggagaatgtatattgcctctgctcctatcagggttgctaaaccctggtacatcgtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgtcatcaggaatcaaaacccacagtccattgtgaagtgtgctatatttagaacagtcttaaaatgtacagtgtattttatagaattgaagttaacattcttattttcaagagaatttatggacgttgtagaaatgtacaaatgcatttccaaactgccttaaacgttgtatttttatagacatgttttttaaaaatcctaagtttttaaataactatggatttgtgtattttttttggttatttgttttattaaaacatgtacatcagtaaagagttttaaacaatgaaaacacatagtaaaaagaataaaaaaaaaatttgggggcttgggctagaaagttatacaacttgttggg

SEQ ID NO: 287830 - DNA, 545 bp, Homo sapiens
ttaaatatgcggagaatgtatattgcctctgctcctatcagggttgctaaaccctggtacatcgtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgtcatcaggaatcaaaacccacagtccattgtgaagtgtgctatatttagaacagtcttaaaatgtacagtgtattttatagaattgaagttaacattcttattttcaagagaatttatggacgttgtagaaatgtacaaatgcatttccaaactgccttaaacgttgtatttttatagacatgttttttaaaaatcctaagtttttaaataactatggatttgtgtattttttttggttatttgttttattaaaacatgtacatcagtaaagagttttaaacaatgaatatggtgtagttactttccagagt

SEQ ID NO: 287831 - DNA, 380 bp, Homo sapiens
gccctcgcgccccccgccgttggctgcgggagagcccgcgtcccactcccgtgctcgcctcgaccccgcgccgggcacctgtggcttgggacagatagaagggatggttggggatacttcccaaaactttttccaagtcaacttggtgtagccggttccccggccacgactctgggcacttcccctgaagctcctctccggagcttgacttcttggacctcctcccccgccccaattccaagctccagaaactcccaactcgtctgccgtccagaaagctagctgcagtgttcaggacgtccgggaggaagcaagcatgtgggggacagaacagtagtcctggactcgaaagggaaggtgctgaccagtggggccttagc

SEQ ID NO: 287832 - DNA, 1477 bp, Homo sapiens
agcagccggcacggggacagccggccgcacaacggatctgcaggcgcggagcaaaatgcacccgccgcgccgcgcggtcctgcagccccgccacggccccgcggcccgcacccccccggggcgacagtgagcctctcccgccaccaccgggggccgagcggagggctctcgggtgggagagcgggaccagatctcgacagctgttcattcccctgaagctcctctccggagcttgacttcttggacctcctcccccgccccaattccaagctccagaaactcccaactcgtctgccgtccagaaagctagctgcagtgttcaggacgtccgggaggaagcaagcatgtgggggacagaacagtagtcctggactcgaaagggaaggtgctgaccagtggggccttagcaatttgaagggttgggaaggaggaattatatttgcaaaggggctgtctattagcatatttcctttgagggggcaaaaaaaagtgccagtatcgacttttacagattgtggccagtgaggatattataatcctatgtaaacagaaaagtcccacttaccgattcattctttcactgtttgtatctgcgcccagaattctcagtgacgtgggggtgagggtgggtggcgattgccttagagggaacccctaaattggttttggataagtttgagcccttgaccttaatttcattgctaccactctgatctcttagcacatttcttaggattaagggtccaaaaatgctgatctaaggggttgccatggtgttgaacaatgcaactttttatttaaaaaagctctgcactgccatgtatgaaagtctctttatgatgtttgtttttttgtcatttttgttctttacatcaagaaattttatgtttaaatatgcggagaatgtatattgcctctgctcctatcagggttgctaaaccctggtacatcgtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgtcatcaggaatcaaaacccacagtccattgtgaagtgtgctatatttagaacagtcttaaaatgtacagtgtattttatagaattgaagttaacattcttattttcaagagaatttatggacgttgtagaaatgtacaaatgcatttccaaactgccttaaacgttgtatttttatagacatgttttttaaaaatcctaagtttttaaataactatggatttgtgtattttttttggttatttgttttattaaaacatgtacatcagtaaagagttttaaacaatgaaaacacatagtaaaaagaataaaaaaaaaatttgggggcttgggctagaaagttatacaacttgttggg

SEQ ID NO: 287833 - DNA, 2053 bp, Homo sapiens
tgcaacatgaggacataggactctttaattccaaaggctcttccaacccagagaacccatctgcccccatgaccttctcccagagcttgagacatggcctgagccccctgctgccataggacttggggcctatctgccattgcaggacctgatttaacagctctcttcttccaatactgggcagtagagtttcggaaactgacaaatgtgtggtctcttcagtgcccagtgtgtaacctggcatggtttgggtgtgctaggagtttgtgaaatgaatgttttcaagacgcaaacgctgctatgcccatcaggtgtgcacagcaggcctgaggatcatgatgagactccctttttatgcagcaaagcacaaagtgtgacagtcgtggccttcctggtggccagacttctagcaactttagccacccaccaaatgacatcacatacagaaggcctcagaaagggaggaggtcgtaaggacacacagctgatgaagggtcagtgctcagctatcaaggtcatcttctggcctggttgcctcccacagcccaggatgcattcaaggctgcacatcaggagcataaataagggtggtcagctcaggcccactggctgcaacaagtagccactgacagggagtctggggccatttggtgcagaacaacccccaacccagtggccatcttcacaactgcagcacagtgctggccctaatgccaggtgagcgtgcaaagtcctgtttctttgtctttacatagggaccgggcgatgcgctttagagaaattccctattatttcacaggaaaggaggctgtgaaaaggagagggcaggttttggagccaagtcgacctggcatcaggtcctggctgccttttttttttttttttttttttaaagacatacatggtcttgctttgtcgcccaggctggagtgcagtggcagtgtcatggctcactgcagcctcaacctgctgggctcaagcaatcctcccacctcagcccgagttgctgggatgacaggcacacgccaccatacccagctaatttttatattttttatagaaaccaggtctcactatgttgcccaggccggtcttaaactttgcccaggccagtcttgaactcctgagctcaagcaatcctcctgcctcagcctcccaaagtgctaggattacaggcgtgagccacttacccggcctctgcctcttgttaatttgaccacatcatgtacctgctgtgcccgttccttcctccgtagaagagggtgctggtcctgcccttttgaggcctccatgagggccaaatgtgccatgggacacttagtgccatgcctgcgcagacctgtggaataaacagcaattctgagcaggctcattttaaagggacttgcaaatttgggcgttccttgtgtgccttcctcataaaacccactcctcccagaatatgcttagaggtgctgctgtatttacctgagagctatgcttttcatcgaaaacctaaacgtgatcatctcttggatgaggtgtggccctgcaccctcgcctgctcgtggaaggagtctgggccagcagtgacccatgcgctagggtctctgctgaggaagtggcaggtgtgtggccctgccctggccccgtagtgagtgtggggcccacctgtgccctcatgggcagctgaagggggagctttctaccccaggttcctttccttactgaaaagtcttgagcaaacagttgccgctctccaccccctgctttttaaaaaaaattttttctcacgtaagaaaatgttatctgtgtgctggggaaaattttgaaaataacaaaaaccagaatacaaacacccataatcaatcacagagataaccactgttcataattccttccagtcttcttacttggcacatatacatttgtctttctttatatatgacatatggatattttacaaagttaggatcctactctatgcactgcttggtgatcggatctattcaatgtacaaaatattttgaaagtttctgtgattaaatgttctttgaaaacataaaatttagca

SEQ ID NO: 287834 - DNA, 556 bp, Homo sapiens
gactgggtcatcgccccccaaggctactcagcctattactgtgagggggagtgctccttcccgctggactcctgcatgaacgccaccaaccacgccatcctgcagtccctggtgcacctgatgaagccaaacgcagtccccaaggcgtgctgtgcacccaccaagctgagcgccacctctgtgctctactatgacagcagcaacaacgtcatcctgcgcaagcaccgcaacatggtggtcaaggcctgcggctgccactgagtcagcccgcccagccctactgcagccacccttctcatctggatcgggccctgcagaggcagaaaacccttaaatgctgtcacagtcaagcaatcctcccacctcagcccgagttgctgggatgacaggcacacgccaccatacccagctaatttttatattttttatagaaaccaggtctcactatgttgcccaggccggtcttaaactttgcccaggccagtcttgaactcctgagctcaagcaatcctcctgcactccagcctgggcaacagagcaagactccgtctcaaaa

SEQ ID NO: 287835 - DNA, 440 bp, Homo sapiens
tgctgggattacaagtgtgagccaccacgcccagccatattggaagattattgagtcctgtttatcggttttatccagcaaagagaccttttagaagatttttgttgcaggtgcttaaagctctacccccaagccattagaaataaaactggttctggatacctgagaatgccctttctgttctagaaaataatgctttaaattctgaaaatagctgttttgaaagatgggcgcagtcaactggtggtagcaataaagaaattattgtatactaccttacctttccaaggcatagtagagcaaggtaagatagagcatcagtttcagatagattatcttgacattacattgaatatgattttccttgcttgcttccaggatcgagatttagagagacttcgtagaaaatggctaaatgcattaacaaaacgtcaggagta

SEQ ID NO: 287836 - DNA, 1008 bp, Homo sapiens
agctagtggaaaaacaagagaagggaagtcaaaaggctacttgctgtcagctaaagccagacaacctctcctgtttcatctcctggcaacagaatgcatcctccttttgggaaactgcctctttccccactcctcagagtaaatcttgctgctgctcactctttgggtctgcactgcccataagagctgtagcactcaccgcgaaggtctgcagcttcactcttgaaaccagagagaccacgaacctaccgggagaaatgaacaaattccggacgcaccatctttaagaactgtaacactcactgcgaggatctgcggcttcattctttaagtctgtgagaccaagaacccaccaattccggcacactaatatgctgttggaaactggctatatggaaaggctatgtggaagaaaacaaacaccccagccaacataatggagctcccagctgacagctgacatctagctgattgccaaccactttggaaactgatcttcaaaacccacttgagctatgtcaagagaagccacctgtgacacagaagcagaaggatccaagtcaaaggagtttatttgggaggaaatagcacgagagaatgtgatacttgggaaaattatgtagagagagagattaaagatgcaagctataaaaggaattgataatataaaagctcctgagaagattggaagaatacatataagagaccctgatccttgataggatggaccttttctagaactaccatcaccctggaagctgaagaaaatcattcgtaactgaggcacacttgccttttgcaactaagctctactgaattccaaagctatagaaatatccatcttgacctggaaagtctgtttctttgctagtccagaaggttttttttaacatgaacaagatcctctcaagcactgtttgctttggactcctaactttgttatccgtgttgagttttttacaatctgtgcatggacgaccatatcttacccaaggtacgtgcatatca

SEQ ID NO: 287837 - DNA, 718 bp, Homo sapiens
ggcgccgagcggggccccgagcgcagcagcagcgccggacgcggcgcaaagtccggccggcagggctcgcaggccggagaacggagcgggtcgggcgggcaggggctggtgaccaaagcagcgggagacggtccccgaggcaccaagctggcggcccagctgccccgccgcggccacctgctccgcgtccccggccccaatcgataccaaatatccggagcccggaaatggaccggggccgtccaaggagagatggtagatggccataaaaaccccaaatacaacgtacagaatgaagagcagctgataaaattctgggccagtttggagtagagtgtgtacacaatcagctgggagaactgagtcattcattcatcaaaatcgcatgaatgtgtctaccaagtgtgatgttagacaacctctcctgtttcatctcctggcaacagaatgcatcctccttttgggaaactgcctctttccccactcctcagagatctgcctctaggagatgatgaggccaaactgaagacagaagcaaagagaagagaaagggagatgaagagggcatgttctgatgttaccacagtagcaaagcaggatatccccagagcagctggcatttcagcaactcctggattctgggatctacaacccgcaaactctcaacttatcctcagttttgcttaagctagtaatagttgattttctgtcactcaca

SEQ ID NO: 287838 - DNA, 819 bp, Homo sapiens
aggtctgtaaccgcaattgcgagtggctggcgagcgaagatcagcgcccgctgccgcctcgctgttgtctcctttgtgctcagtgacgcgccgcctgaggctggggccccgctgtgctcccgcccccgggccctgcccccctcctacgggagggtcgcgtctttaggtgggggccttgtatcctaaaggcctcaacaaaaaggccacacgggtcacctaaaacatagtctttcccgtgagcggtgtagtcagcattctgtggtctggttctgggattgagattaacacaggatgtttactgcatgcttgcctctctctcatacactctttttgcacccggaattagaggagagatggtagatggccataaaaaccccaaatacaacgtacagaatgaagagcagctgataaaattctgggccagtttggagtagagtgtgtacacaatcagctgggagaactgagtcattcattcatcaaaatcgcatgaatgtgtctaccaagtgtgatgttagacaacctctcctgtttcatctcctggcaacagaatgcatcctccttttgggaaactgcctctttccccactcctcagagatctgcctctaggagatgatgaggccaaactgaagacagaagcaaagagaagagaaagggagatgaagagggcatgttctgatgttaccacagtagcaaagcaggatatccccagagcagctggcatttcagcaactcctggattctgggatctacaacccgcaaactctcaacttatcctcagttttgcttaagctagtaatagttgattttctgtcactcaca

SEQ ID NO: 287839 - DNA, 460 bp, Homo sapiens
cgcgtcgacccagccccgggccagcctttttagccataagaaagtggctgtccggggctggagccgcctggcgggcgccacgtatcggggtgtctacggcaccagcctcctgcgccacgccaaggtcgtctgggagatgctcaagtttgaagtggcgctcaggctggagaccttggccatgcggctgaccgccctcctggctcgtgctctggtccacctgagcctcgtgcccccagcggaggagctctaccagtacctggagacctagggtgcagccgcccagggccggcggggcccttttcaccttgggctgacggaggtggcggggctagaggtgtagacaccccgagccccgtgggcactcgcactggggggctgtgacagcagctgggccaggaggccgtgtaatgaccacacactcctctcaagcaaaaaaaaaaagtcgacgcggccgcgaatt

SEQ ID NO: 287840 - DNA, 967 bp, Homo sapiens
cggcgggctggtgctgtgtccactgcaatgcctctcctctccccagatagcagaaaagctcatcaaggcctttgctgagcagatattttacaccggcttcatccactcggacccacatcctggcaacgttctggtgcggaaaggcccggacgggaaagcggagctggtgctgctggaccacgggctctaccagttcctggaggagaaggaccgcgcagccctctgccagctgtggcgggccatcatcctgcgggacgacgccgccatgagggcgcacgcagccgcactgggggtgcaagactacctcctgttcgccgagatgctcatgcagcgccccgtgcgcctggggcagctgtggggctcgcacctactgagccgcgaagaggcggcctacatggtggacatggcccgcgagcgcttcgaggccgtcatggcggtgctcagggagctgccgcggcccatgctgctggtgctgcgcaacatcaacaccgtgcgcgctatcaacgtggccctcggcgcccccgtggaccgctacttccttatggctaaaagggctgtccggggctggagccgcctggcgggcgccacgtatcggggtgtctacggcaccagcctcctgcgccacgccaaggtcgtctgggagatgctcaagtttgaagtggcgctcaggctggagaccttggccatgcggctgaccgccctcctggctcgtgctctggtccacctgagcctcgtgcccccagcggaggagctctaccagtacctggagacctagggtgcagccgcccagggccggcggggcccttttcaccttgggctgacggaggtggcggggctagaggtgtagacaccccgagccccgtgggcactcgcactggggggctgtgacagcagctgggccaggaggccgtgtaatgaccacacactcctctcaagcaaaaaaaaaaagtcgacgcggccgcgaatt

SEQ ID NO: 287841 - DNA, 945 bp, Homo sapiens
gagccaggggtggcagtgcatgacatagcagaaaagctcatcaaggcctttgctgagcagatattttacaccggcttcatccactcggacccacatcctggcaacgttctggtgcggaaaggcccggacgggaaagcggagctggtgctgctggaccacgggctctaccagttcctggaggagaaggaccgcgcagccctctgccagctgtggcgggccatcatcctgcgggacgacgccgccatgagggcgcacgcagccgcactgggggtgcaagactacctcctgttcgccgagatgctcatgcagcgccccgtgcgcctggggcagctgtggggctcgcacctactgagccgcgaagaggcggcctacatggtggacatggcccgcgagcgcttcgaggccgtcatggcggtgctcagggagctgccgcggcccatgctgctggtgctgcgcaacatcaacaccgtgcgcgctatcaacgtggccctcggcgcccccgtggaccgctacttccttatggctaaaagggctgtccggggctggagccgcctggcgggcgccacgtatcggggtgtctacggcaccagcctcctgcgccacgccaaggtcgtctgggagatgctcaagtttgaagtggcgctcaggctggagaccttggccatgcggctgaccgccctcctggctcgtgctctggtccacctgagcctcgtgcccccagcggaggagctctaccagtacctggagacctagggtgcagccgcccagggccggcggggcccttttcaccttgggctgacggaggtggcggggctagaggtgtagacaccccgagccccgtgggcactcgcactggggggctgtgacagcagctgggccaggaggccgtgtaatgaccacacactcctctcaagcaaaaaaaaaaagtcgacgcggccgcgaatt

SEQ ID NO: 287842 - DNA, 843 bp, Homo sapiens
ttttttttttttggtgctgtgcttttgaagcccagtgtgttttatgtattacagcacatcttggtttggacagaccacatagtggccagtggctgccatattggacagcactggtgtaagagggtccatctctcactcccacatcaatgtccaatggtttctcattcaactggaaagtgaaattggaaatcttgtgaaagatgaagaattatgaatgtggtacgttgaactgctgggcccacccacaagacatcaacaaatgaaggtgtggaagggttaaaccagttaacgttgaacaaaggacaatggatatgatgagttacaagctgagttgtatccctccacaattcacatgttgaagtcctaacctttagtacttcagggtgtaacttatttggaaactagatcattatagaagttaaaacgaggtcataagggtgggccctaatcttactaacctgtccctataaaagggaaatttgaacacagtgacacccagagggaagatgatgtgaagacagagagagaagacagccatcagcaagccaaggagagaagtctggaatggatcctcccctcacagccctcagaaggaaccaagccagccagcctctcaatctcacacttttagcctccagatctgtgagacaataagtttatgttgtttaagccctccagtctgtggtactttgtaatgtagccccagcaaactaaaacatgggttggctggtggcattagaacaagttgcccatgaaaaggttacaggcagcctataggacaattgaagatgcattctactttctgcctgcactgtgcatctagtgaagaaaaaaaaaaaaaac

SEQ ID NO: 287843 - DNA, 854 bp, Homo sapiens
accgcctggcggtactttgaagaaagacttctcgacgccgagacactgctggtggtactcgatgtcacatcttggtttggacagaccacatagtggccagtggctgccatattggacagcactggtgtaagagggtccatctctcactcccacatcaatgtccaatggtttctcattcaactggaaagtgaaattggaaatcttgtgaaagatgaagaattatgaatgtggtacgttgaactgctgggcccacccacaagacatcaacaaatgaaggtgtggaagggttaaaccagttaacgttgaacaaaggacaatggatatgatgagttacaagctgagttgtatccctccacaattcacatgttgaagtcctaacctttagtacttcagggtgtaacttatttggaaactagatcattatagaagttaaaacgaggtcataagggtgggccctaatcttactaacctgtccctataaaagggaaatttgaacacagtgacacccagagggaagatgatgtgaagacagagagagaagacagccatcagcaagccaaggagagaagtctggaatggatcctcccctcacagccctcagaaggaaccaagccagccagcctctcaatctcacacttttagcctccagatctgtgagacaataagtttatgttgtttaagccctccagtctgtggtactttgtaatgtagccccagcaaactaaaacatgggttggctggtggcattagaacaagttgcccatgaaaaggttacaggcagcctataggacaattgaagatgcattctactttctgcctgcactgtgcatctagtgaagaaaaaaaaaaaaaac

SEQ ID NO: 287844 - DNA, 1007 bp, Homo sapiens
accgcctggcggtactttgaagaaagacttctcgacgccgagacactgctggtggtactcgatgtatcacgtggatggcaggagcagtggcaaaggactttcaactgacagacaagcatgagatggtggtcagctacctcccactcagccatattgcagcacagatgatggacatctgggtacccataaagattggggcgctcacatactttgctcaagcagatgctctcaaggggtgactggcaaccatgccgtgaagacactcaagcaattctgtggagaaggccatggaatgaggagctgagacttcctgccaacaaccagtcatctaggtcagaaattcagacagggcacatctgggacagcttgaagtcatgatgtgctggagctggcatgtatcaaccgcatgagtcagagccaattgcatgcatctcttctcagcttcacattcagtggtatcacatctgtaccttgaaatcagccacaggggagtatttacaccacaggaatggcaaacactgcaaatcagcgccccatgccactcaagagccagtttattaaactatttatcagaacataacgtgctttaaagaattatttaaaattctcaacaaatataaagggacatgtattattaaatccttagggatggtcccaccaaaatcccatatacagtaattattagcaagactccaaatgtacttagatttgctaaaattctcaaatgcattagtaaggtaagagaacagaatctcactcattggccagggccagagggtgaccatagtcaaacgtagaccgtgaattcccgaggcacaagagcaaacgacccagccgacgagcactccggagtagaggaacacaagaggtgcacacaaccaatcacgtggcaaagtgtcgataagaggacgacgggcaaaggcccagccggaggcgagaacacaggagccaggagagccccgacaagaaccaaaaggagaacggcacacaccggaacacgcacacgg

SEQ ID NO: 287845 - DNA, 584 bp, Homo sapiens
accgcctggcggtactttgaagaaagacttctcgacgccgagacactgctggtggtactcgatgtcacatcttggtttggacagaccacatagtggccagtggctgccatattggacagcactggtgtaagagggtccatctctcactcccacatcaatgtccaatggtttctcattcaactggaaagtgaaattggaaatcttgtgaaagatgaagaattatgaatgtgtgacacccagagggaagatgatgtgaagacagagagagaagacagccatcagcaagccaaggagagaagtctggaatggatcctcccctcacagccctcagaaggaaccaagccagccagcctctcaatctcacacttttagcctccagatctgtgagacaataagtttatgttgtttaagccctccagtctgtggtactttgtaatgtagccccagcaaactaaaacatgggttggctggtggcattagaacaagttgcccatgaaaaggttacaggcagcctataggacaattgaagatgcattctactttctgcctgcactgtgcatctagtgaagaaaaaaaaaaaaaac

SEQ ID NO: 287846 - DNA, 625 bp, Homo sapiens
accgcctggcggtactttgaagaaagacttctcgacgccgagacactgctggtggtactcgatgtatcacgtggatggcaggagcagtggcaaaggactttcaactgacagacaagcatgagatggtggtcagctacctcccactcagccatattgcagcacagatgatggacatctgggtacccataaagattggggcgctcacatactttgctcaagcagatgctctcaaggggtgactggcaaccatgccgtgaagacactcaagcaattctgtggagaaggccatggaatgaggagctgagacttcctgccaacaaccagtcatctaggtaagtaagcttggaagtgaagcctccagccccagttgagccttcagatgagatagccccagctgatagcttggctgcaacctcatgagagacctggagccagaagaacccaatttcaaagtagctcctaaattctcaatccacagaaactgtgagatgataaatgtttgtcatttcaagtcactatattttgggataatttgttatgcagcagcaactaacaaaaacatagagatagtatgttagggacaaatgcaagatgcagaaccatgggtgtagtaggctattatgtg

SEQ ID NO: 287847 - DNA, 406 bp, Homo sapiens
accgcctggcggtactttgaagaaagacttctcgacgccgagacactgctggtggtactcgatgtaggtgagcaggtggcagctgttggagccgggcgcgatgttgttggcgtacttgatggccgtgctcgcgaccatgtcgtgcacagtgaggagtgtcttgttgctaacttagtccttgctgagccgcagtcgcgcctccccgtcgcgctccgtggtccgagtagctcagcctgcggacaggcgggtcagcggcggccggagacccccagatggacctagagagaggcgagcaggtggcgtgtcaggggcaaaaccagggagagatgggagcacaggcaggagcgtggcactgagagatggcagacggaggaggcgtggtgtatgaagtggattgccaagggag

SEQ ID NO: 287848 - DNA, 2237 bp, Homo sapiens
gggctttattctgtcatacggtagcaagaactggcctattggcatcgtattcctggcattgagctgtattgaccctgaatgtgtcctcctgaggtttttgagggtgacctgggagaaagggtctgaaaaagcattgggatccaagtgactttaaatctgcccgtggcatttcctgctgagaggcgagaaactagcatctctcccaacaggctcacatccgccaggaaggacagagcccaaaacgggggtagactttgtgggaaattcgccagttagtccgctgagattttaatctgcctcaagcacaggatgctgacaagaaaggtagaccactcccccgatcccagacaaaccccaggggtgacaacttctccatcagtatcctgagaagcaacatcaaatgcttaccaagtcagcacgtttactgagtgagtactctgacggaataaaccagcatttggagctgaacttgagaacacagggccctctgacagcagcttagggaaacacccatcccttccagattggcagaatccttccatttcatgtccttcggagacgctgtattctctttacaaatcattcatgaaactgaagctcagtctcccaggggtaagtcctgggccacgtgcaaacaatggcaaatccagctcttccatgatagagaaggcaaacacacccaccttcatcctgagcctaaaaggccacctctgagcacttgggcagccactcctctgggcctcagagggccatgagcttggccaggtaggcacagcggcggggaagtcacagctgtcaggtaccggccatggtgcaggtgggaataggagatgccagagctgctttagctgaggaaagcaaacagtcagcagtgctcaaaggagcaaaacttcgaatgtgcacattgacccctgacacctgcaagcataacacagatcctaagactagagtgaagtaggaagaagaattagaaaatccagtggatgtcctgagtatagggaaccagggccgttgaaaatcagtaaaggttgattacctggggcgagaccgggtgactgtggcagtgcaggtgaaggtaccctggaccttctcagttcgctggcacataaggctccgccaataaagcgtggttctctctgtcatacacacacacacacacacacacacacacacacacacaatgattggagggctatatgatccagcattagcttcctggtgtgccaagcatgcttgatcgggaatttttttttattattattattttttagctgtagctgaaggcatttctcggatgtggagaggagaatggaaatcgcagaaccaaatcagtttgccctgccatatttggctgtggtctgtcattgggcatttctgatgtgcttttctggattcaggaagagctgattgtcctccgagggttgaaaaaaaaaaacagtttcagaaacctgaatccagggccttatagttctcctcattatctatcttcttctcccttccctcgcccaagggagtgggggaaacacttttcactgcagagtttgctttaaagttttcccatcttgcgtgcattatcccttgatattaaaattattttctcagtttaatccaactcctgctgagaagctgtgtgagatttaggctgtggggtttttttcttgtactcttttggatggtgttgcatttttcactcttaacccgagggtgtgtttcagcttatgttcgttctgtttcatgcaggtttatagcacggtagagtagaaggcggcttctgatttttagggtatttttagaattcattcctgagtgaggggttcagacacccagtctcctcggaacaggggtgaggggtcgactgagctttgttgagaagcctccagttaggcttcgggcgggtctccatgttatattgtgtgtttactgagcttcccactggtagaagatgacacatttgtccatcgtcctgtgtatctgctttccagaggacaccggagcattctcctggggtcactcccacatggctgcctcacatagctgttttgcaacagcctttattgccaacacccttggaagaacatctcctgtagaagtacaagttttgcaatatggactttggaagtggttttgtgatgttcgaattttctgttagcctattgctcaagcactacagaatgtacatagtccctttggccatcctctcaccccagaatatcctaataaacattgttttctttttt

SEQ ID NO: 287849 - DNA, 2302 bp, Homo sapiens
gggctttattctgtcatacggtagcaagaactggcctattggcatcgtattcctggcattgagctgtattgaccctgaatgtgtcctcctgaggtttttgagggtgacctgggagaaagggtctgaaaaagcattgggatccaagtgactttaaatctgcccgtggcatttcctgctgagaggcgagaaactagcatctctcccaacaggctcacatccgccaggaaggacagagcccaaaacgggggtagactttgtgggaaattcgccagttagtccgctgagattttaatctgcctcaagcacaggatgctgacaagaaaggtagaccactcccccgatcccagacaaaccccaggggtgacaacttctccatcagtatcctgagaagcaacatcaaatgcttaccaagtcagcacgtttactgagtgagtactctgacggaataaaccagcatttggagctgaacttgagaacacagggccctctgacagcagcttagggaaacacccatcccttccagattggcagaatccttccatttcatgtccttcggagacgctgtattctctttacaaatcattcatgaaactgaagctcagtctcccaggggtaagtcctgggccacgtgcaaacaatggcaaatccagctcttccatgatagagaaggcaaacacacccaccttcatcctgagcctaaaaggccacctctgagcacttgggcagccactcctctgggcctcagagggccatgagcttggccaggtaggcacagcggcggggaagtcacagctgtcaggtaccggccatggtgcaggtgggaataggagatgccagagctgctttagctgaggaaagcaaacagtcagcagtgctcaaaggagcaaaacttcgaatgtgcacattgacccctgacacctgcaagcataacacagatcctaagactagagtgaagtaggaagaagaattagaaaatccagtggatgtcctgagtatagggaaccagggccgttgaaaatcagtaaaggttgattacctggggcgagaccgggtgactgtggcagtgcaggtgaaggtaccctggaccttctcagttcgctggcacataaggctccgccaataaagcgtggttctctctgtcatacacacacacacacacacacacacacacacacacacaatgattggagggctatatgatccagcattagcttcctggtgtgccaagcatgcttgatcgggaatttttttttattattattattttttagctgtagctgaaggcatttctcggatgtggagaggagaatggaaatcgcagaaccaaatcagtttgccctgccatatttggctgtggtctgtcattgggcatttctgatgtgcttttctggattcaggaagagctgattgtcctccgagggttgaaaaaaaaaaacagtttcagaaacctgaatccagggccttatagttctcctcattatctatcttcttctcccttccctcgcccaagggagtgggggaaacacttttcactgcagagtttgctttaaagttttcccatcttgcgtgcattatcccttgatattaaaattattttctcagtttaatccaactcctgctgagaagctgtgtgagatttaggctgtggggtttttttcttgtactcttttggatggtgttgcatttttcactcttaacccgagggtgtgtttcagcttatgttcgttctgtttcatgcaggtttatagcacggtagagtagaaggcggcttctgatttttagggtatttttagaattcattcctgagtgaggggttcagacacccagtctcctcggaacaggggtgaggggtcgactgagctttgttgagaagcctccagttaggcttcgggcgggtctccatgttatattgtgtgtttactgagcttcccactggtagaagatgacacatttgtccatcgtcctgtgtatctgctttccagaggacaccggagcattctcctggggtcactcccacatggctgcctcacatagctgttttgcaacagcctttattgccaacacccttggaagaacatctcctgtagaagtacaagttttgcaatatggactttggaagtggttttgtgatgttcgaattttctgttagcctattgctcaagcactacagaatgtacatagtccctttggccatcctctcaccccagaatatcctaataaacattgttttcttttttaaagaagatagtataatgacactcctgaaggggaaaaaaaacgcggggactagaggggggggaaa

SEQ ID NO: 287850 - DNA, 1194 bp, Homo sapiens
  misc_feature (28)..(28): n is a, c, g, or t
  misc_feature (38)..(38): n is a, c, g, or t
acttcgggaacagcgctgtacatacaanattacaatanactgattagctgtagactaataaaacatttaagacttcacacacacacacacacacacacacacacacacacacacacacacacacacacacacacacaatgattggagggctatatgatccagcattagcttcctggtgtgccaagcatgcttgatcgggaatttttttttattattattattttttagctgtagctgaaggcatttctcggatgtggagaggagaatggaaatcgcagaaccaaatcagtttgccctgccatatttggctgtggtctgtcattgggcatttctgatgtgcttttctggattcaggaagagctgattgtcctccgagggttgaaaaaaaaaaacagtttcagaaacctgaatccagggccttatagttctcctcattatctatcttcttctcccttccctcgcccaagggagtgggggaaacacttttcactgcagagtttgctttaaagttttcccatcttgcgtgcattatcccttgatattaaaattattttctcagtttaatccaactcctgctgagaagctgtgtgagatttaggctgtggggtttttttcttgtactcttttggatggtgttgcatttttcactcttaacccgagggtgtgtttcagcttatgttcgttctgtttcatgcaggtttatagcacggtagagtagaaggcggcttctgatttttagggtatttttagaattcattcctgagtgaggggttcagacacccagtctcctcggaacaggggtgaggggtcgactgagctttgttgagaagcctccagttaggcttcgggcgggtctccatgttatattgtgtgtttactgagcttcccactggtagaagatgacacatttgtccatcgtcctgtgtatctgctttccagaggacaccggagcattctcctggggtcactcccacatggctgcctcacatagctgttttgcaacagcctttattgccaacacccttggaagaacatctcctgtagaagtacaagttttgcaatatggactttggaagtggttttgtgatgttcgaattttctgttagcctattgctcaagcactacagaatgtacatagtccctttggccatcctctcaccccagaatatcctaataaacattgttttctttttt

SEQ ID NO: 287851 - DNA, 942 bp, Homo sapiens
gacgagaaggagactgggcacacactaggatcccagccccggccctgccccccgggacacattggcacttgggcattctcacgggtcacggcaaggccagcttgaccaagaggtcaaaggcgactggcgtcccactgaccgctgggggtttggcctcaaacttcaggtgaacccacaattccggaatagcgggaccggcacccgggcccttctcacgtggcagcaccggcaaggggctgggggaagagcccacgccagcctacgtcacgcaggaagggagccagtggccaccccaaacacacctctcctcctcacacctggcctacgtccaactctccacggctctgcccagaaggctgcacgtacaacacacacagaggcgggcatttccctgacgactcgtgtgtgccgtgggggagcggtagatggcccagccccaagtgttccgatcttcctgcccaaacatattctgtgacggaaagcctatgttgacctcgtccggcactcaaggcgtgggcagcggcctaacgtctgctgcgggaacacagtcgcgttgaatgctattctcaagacagacaaaacagtgggaagacactacgccaagctgctaactccctggccattgccggactctttcacccccatggactttccgctggcattttaaacaacatagtttcttttctctgtctctttctctttctctctctctttctctttctctctctctctctctctctctgtcaatctcataatttctctctctcgtgccacgttcccacccaacgctctctcgcccacttctactggggcccacttcctctcctgctctctctgtctcaacgtgattgactttcttgtgctgcccaggacttcttgcccacgtgcgccttcaaaacggtaagagctgcaactgaacgtgtgagacatggtgcagatagg

SEQ ID NO: 287852 - DNA, 1648 bp, Homo sapiens
aattcggcacgagccggctgctgcggacctcctcggacccggacccagccccagcccggccccagccagccccgacggcgccatgcggggtccgagcggggctctgtggctgctcctggctctgcgcaccgtgctcggtggcatggaggtgcggtggtgcgccacctcggacccagagcagcacaagtgcggcaacatgagcgaggccttccgggaagcgggcatccagccctccctcctctgcgtccggggcacctccgccgaccactgcgtccagctcatcgcggcccaggaggctgacgccatcactctggatggaggagccatctatgaggcgggaaaggagcacggcctgaagccggtggtgggcgaagtgtacgatcaagaggtcggtacctcctattacgccgtggctgtggtcaggaggagctcccatgtgaccattgacaccctgaaaggcgtgaagtcctgccacacgggcatcaatcgcacagtgggctggaacgtgcccgtgggctacctggtggagagcggccgcctctcggtgatgggctgcgatgtactcaaagctgtcagcgactattttgggggcagctgcgtcccgggggcaggagagaccagttactctgagtccctctgtcgcctctgcaggggtgacagctctggggaaggggtgtgtgacaagagccccctggagagatactacgactacagcggggccttccggtgcctggcggaaggggcaggggacgtggcttttgtgaagcacagcacggtactggagaacacggatgaaagtccatcacgaaggcaaacatggaccagatctgaggaggaagaaggcgagtgccctgcacacgaggaagcacgtaggacgatgcgctctagtgctgggcaagcctggaaatgggctcccgttcacaggccccaggacgagtctgacaaaggagaatttggaaaacgggcaaagagtagggatatgttgggttaagaatcagctctttcaaacttggggttttttttgggatgggggtctcaccatgttgcccaggctggtctcaaacccccagcctcaactgatcctcgcatctcagcctcctgagtagctgggatgacaggcgtgcacctggcagctttttcaaagtgttgatggtaatctgaggcaatctaagggagtcattttttaagtgactttatacagaaagattggtaagagccaaggggtagaagtggcataaatgtctaaagcagggaagtgacaggactttcattgttcttggctgaggagaagcgggagtggctgatggaagcacctaaatgatgcctttgtctgtgggaaggcaaatgatgccccagagctctaaccaaaggttttgcagccgccgaaaaacaggaaagttgggaagcgggggtaggactacactgaatcattaacagtgctgtaaactaccatgtggccattaacaatgacctttagggagttttcctaaacgatcactctggtgcgggtgtttggttttgttttaaaatagctttgcagtgaaagctttcatgaccatacaaattatcttttttcttcctatttccttgtagaggtttttttcctccttgtcttaaggtcataaaaatattgttatgtgggaccatc

SEQ ID NO: 287853 - DNA, 2390 bp, Homo sapiens
aattcggcacgagccggctgctgcggacctcctcggacccggacccagccccagcccggccccagccagccccgacggcgccatgcggggtccgagcggggctctgtggctgctcctggctctgcgcaccgtgctcggtggcatggaggtgcggtggtgcgccacctcggacccagagcagcacaagtgcggcaacatgagcgaggccttccgggaagcgggcatccagccctccctcctctgcgtccggggcacctccgccgaccactgcgtccagctcatcgcggcccaggaggctgacgccatcactctggatggaggagccatctatgaggcgggaaaggagcacggcctgaagccggtggtgggcgaagtgtacgatcaagaggtcggtacctcctattacgccgtggctgtggtcaggaggagctcccatgtgaccattgacaccctgaaaggcgtgaagtcctgccacacgggcatcaatcgcacagtgggctggaacgtgcccgtgggctacctggtggagagcggccgcctctcggtgatgggctgcgatgtactcaaagctgtcagcgactattttgggggcagctgcgtcccgggggcaggagagaccagttactctgagtccctctgtcgcctctgcaggggtgacagctctggggaaggggtgtgtgacaagagccccctggagagatactacgactacagcggggccttccggtgcctggcggaaggggcaggggacgtggcttttgtgaagcacagcacggtactggagaacacggatgggaagacgcttccctcctggggccaggccctgctgtcacaggacttcgagctgctgtgccgggatggtagccgggccgatgtcaccgagtggaggcagtgccatctggcccgggtgcctgctcacgccgtggtggtccgggccgacacagatgggggcctcatcttccggctgctcaacgaaggccagcgtctgttcagccacgagggcagcagcttccagatgttcagctctgaggcctatggccagaaggatctactcttcaaagactctacctcggagcttgtgcccatcgccacacagacctatgaggcgtggctgggccatgagtacctgcacgccatgaagggtctgctctgtgaccccaaccggctgcccccctacctgcgctggtgtgtgctctccactcccgagatccagaagtgtggagacatggccgtggccttccgccggcagcgcctcaagccagagatccagtgcgtgtcagccaagtccccccaacactgcatggagcggatccaggctgagcaggtcgacgctgtgaccctaagtggcgaggacatttacacggcggggaagaagtacggcctggttcccgcagccggcgagcactatgccccggaagacagcagcaactcgtactacgtggtggccgtggtgagacgggacagctcccacgccttcaccttggatgagcttcggggcaagcgctcctgccacgccggtttcggcagccctgcaggctgggatgtccccgtgggtgcccttattcagagaggcttcatccggcccaaggactgtgacgtcctcacagcagtgagcgagttcttcaatgccagctgcgtgcccgtgaacaaccccaagaactacccctcctcgctgtgtgcactgtgcgtgggggacgagcagggccgcaacaagtgtgtgggcaacagccaggagcggtattacggctaccgcggcgccttcaggtgcctggtggagaatgcgggtgacgttgccttcgtcaggcacacaaccgtctttgacaacacaaacggccacaattccgagccctgggctgctgagctcaggtcagaggactatgaactgctgtgccccaacggggcccgagccgaggtgtcccagtttgcagcctgcaacctggcacagataccaccccacgccgtgatggtccggcccgacaccaacatcttcaccgtgtatggactgctggacaaggcccaggacctgtttggagacgaccacaataagaacgggttcaaaatgttcgactcctccaactatcatggccaagacctgcttttcaaggatgccaccgtccgggcggtgcctgtcggagagaaaaccacctaccgcggctggctggggctggactacgtggcggcgctggaagggatgtcgtctcagcagtgctcgggcgcagcggccccggcgcccggggcgcccctgctcccgctgctgctgcccgccctcgccgcccgcctgctcccgcccgccctctgagcccggccgccccgccccagagctccgatgcccgcccggggagtttccgcggcggcctctcgcgctgcggaatccagaaggaagctcgcga

SEQ ID NO: 287854 - DNA, 1781 bp, Homo sapiens
aattcggcacgagccggctgctgcggacctcctcggacccggacccagccccagcccggccccagccagccccgacggcgccatgcggggtccgagcggggctctgtggctgctcctggctctgcgcaccgtgctcggtggcatggaggtgcggtggtgcgccacctcggacccagagcagcacaagtgcggcaacatgagcgaggccttccgggaagcgggcatccagccctccctcctctgcgtccggggcacctccgccgaccactgcgtccagctcatcgcggcccaggaggctgacgccatcactctggatggaggagccatctatgaggcgggaaaggagcacggcctgaagccggtggtgggcgaagtgtacgatcaagaggtcggtacctcctattacgccgtggctgtggtcaggaggagctcccatgtgaccattgacaccctgaaaggcgtgaagtcctgccacacgggcatcaatcgcacagtgggctggaacgtgcccgtgggctacctggtggagagcggccgcctctcggtgatgggctgcgatgtactcaaagctgtcagcgactattttgggggcagctgcgtcccgggggcaggagagaccagttactctgagtccctctgtcgcctctgcaggggtgacagctctggggaaggggtgtgtgacaagagccccctggagagatactacgactacagcggggccttccggtgcctggcggaaggggcaggggacgtggcttttgtgaagcacagcacggtactggagaacacggatgggaagacgcttccctcctggggccaggccctgctgtcacaggacttcgagctgctgtgccgggatggtagccgggccgatgtcaccgagtggaggcagtgccatctggcccgggtgcctgctcacgccgtggtggtccgggccgacacagatgggggcctcatcttccggctgctcaacgaaggccagcgtctgttcagccacgagggcagcagcttccagatgttcagctctgaggcctatggccagaaggatctactcttcaaagactctacctcggagcttgtgcccatcgccacacagacctatgaggcgtggctgggccatgagtacctgcacgccatgaagggtctgctctgtgaccccaaccggctgcccccctacctgcgctggtgtgtgctctccactcccgagatccagaagtgtggagacatggccgtggccttccgccggcagcgcctcaagccagagatccagtgcgtgtcagccaagtccccccaacactgcatggagcggatccaggtgggagtcacgcaggtgcagcgtgggccaggtgggcgggtggtggcagtgcctgggcagttcttactacccacaccccctgctgcctggggaagaggagagtgtctactgcaacaagcccacagagacgggtggggaggagcgaccgcaggggccagcacccaccccaggggacagagacaggcggggaggagcgaccgcaggggccagcacccaccccaggggacaggcagataggggtgagtcccctggagagcctgggagctcctcactaagtgggggtgccaggagcagaagaagcgctggcccagctgggcactgacgccctgtagcctggggcaagccccttcccctttctgaatctcagccttcccttgtgcaatagagagtgggcgtggatcattgttcgactttttttttcttttttcctgatttttctaaatagacaaataataattgtgcatat

SEQ ID NO: 287855 - DNA, 1495 bp, Homo sapiens
ttaggctaggtacgaggctgggtttgaatcggccgagggggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgcatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagtt

SEQ ID NO: 287856 - DNA, 1853 bp, Homo sapiens
agaacgcagaccagcccaagctgacagcttgagtatgccttcttctgctgcctggttttgggggctgtatgacgtactggtcggtagtaaagattaatatgtaagaaatgtggagctaggatcaagtcatactccacagcctgcctggcaaactatgttttacttctgactttgctctctcgctgagaacattaatctgtcaagctggcgggctcctttgatagcaactttcccaggggcatgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcaggacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtggatcttcttcatgccagccataccgggcaggaaccatcagagagacacactgaggaggcactcagaaaattttgatagaattgaatttacatatagctgataaagcctaaatagaaaggttgatgtatttagcttgaatccttcactttagtggtctaatcaacagataaatgacaagcaaagaatgaaacaatccaaaaatgtttttcaaaacaattttgtgaattttatttttacaaaaattttttaaattcatattttaaaatgtataccaaggcaaaaaaatcatataagctatatcataaatacaagagtttcaaaacatacaagagacatataatgtaaaaaaaaattatatatatgaagtccaatgtaatttataatacaaaaaaatacagcaagggaaaatgctttagaaatgctcatctgcaaactacaaaaca

SEQ ID NO: 287857 - DNA, 3002 bp, Homo sapiens
  misc_feature (174)..(174): n is a, c, g, or t
ctcgaagagcctgtacaggaagatgcaacacaagaaacacacatttcatctcctgttgagtctccttcccaaaagaccaaaagtgaaaccgtcactggagaattatcaaaactcttggatgaaataaaactctgtcaagaaaaggattattcgtttgaagacttgtgccacacnatatcagaccactacttagataatttgagcaagatttcagaggaagaacttgggaaaaatggaagccagagtgtaagaacctcatctacaatcaatttgtcaccaggagaagtggaagaagaggatgatgatgaaaatacgtgtgggccatcaggactttgggaagcattaactccgtgtaatggatgtaggaaccttggcttccccatgcttgcccaggagtcctatccaaagaagagaaattacactatggaaattgtaccatctgcttctctggatacatttccttcagaaaatgagaactttctgtgtgatctcatggacacagctgttacaaagaaaccttgctccttagaaattgcaagggcaccttccccaagaactgataatgcctctgaggtagcagttactactccaggaactagtaaccatagaaacagctcaacaggcccaacacctgattgttcacctccatcccctgatactgccctcaaaaatattgtaaaagtcattcgaccccagcctaaacagcgaacatccattgtgtcttctctggattttcaccgaatgaatcacaaccaagaatattttgaaatcaacacatctacagggtgcacaagctttactgccagtcctcctgctagtccacccacctcttctgtgggaaccacagaagtcaagaatgagggaactaaccatacagatgacctctcccgacaggatgacaatgatcccccaaaagaatatgatcctgggcaatttgcaggcctgctccatggatcctctccagcctgtgagtcccctgaaaatccatttcatctctatgggaaaagagaacaatgtgaaaaaggacaagatgaagtcagtttggcaaacagtcctttgcctttcaagcagtctccaatagaaaataactcagaacctttggtaaagaaaattaaacccaaagtggtcagtagaacaatttttcacaaaaaaagcaaccaactcgaaaaccataccattgttggcacaagatcaaccaggagtggatctcggaatggggaccagtgggttatgaacgcagggggatttgtggagagagcctgtactctggggagaataaggtcattgcctaaagccttgatcgacatgcatttgtcaaaaagtgtctctaaatctgattctgatctcattgcctatccttccaatgagaaaacatcaagagttaactggagtgaatcttccactgctgaacacagttctaaagggaattctgaaagaacaccatccttcacatcggaatgggaagaaattgacaaaataatgagttccatagatgttggaatcaacaacgaacttaaagagatgaatggtgagaccacaagacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtggatcttcttcatgccagccataccgggcaggaaccatcagagagacacactgaggaggcactcagaaaattttgatagaattgaatttacatatagctgataaagcctaaatagaaaggttgatgtatttagcttgaatccttcactttagtggtctaatcaacagataaatgacaagcaaagaatgaaacaatccaaaaatgtttttc

SEQ ID NO: 287858 - DNA, 995 bp, Homo sapiens
  misc_feature (951)..(951): n is a, c, g, or t
ggcagaggggggcgcgcgcgcgggcctggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagcagtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaaccatattggtgggcntgaaacatccggaatattcctggggggccagagccagaagaacc

SEQ ID NO: 287859 - DNA, 1354 bp, Homo sapiens
agaacgcagaccagcccaagctgacagcttgagtatgccttcttctgctgcctggttttgggggctgtatgacgtactggtcggtagtaaagattaatatgtaagaaatgtggagctaggatcaagtcatactccacagcctgcctggcaaactatgttttacttctgactttgctctctcgctgagaacattaatctgtcaagctggcgggctcctttgatagcaactttcccaggggcatgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcagggtaagtgccaagcacattcatctggttctctgcccttatcttaagaactatttgtttgagaccagcctggccaacatggtgagaccctgcctctactgaaaacagaaaaaatttagccaggtgtggttgtgcctgtctgtagtcccagctactccggaggctgagacatgaaaatcacttgaacccagaaggcggagcattgcagtgagcagagatcgcaccactgcactccagcctgggcaacagagtaagaaaataaaagaattattttatgtagttttataggttttataaacgtgcactttatacaactgaagcaatagatcaggaagtgctggctcttttctatgaagtttaccatatctgtgtagaaaacaatctgtcttttgattgtttgacacaatcaaaacaacaagatttgtttttctagattggttaaatatatatttttgagatttagatatccatctataatggaattcagcctgacaaaccactacctttaaagaaccactccctcacctcccatcccacaccccatctacgccaa

SEQ ID NO: 287860 - DNA, 749 bp, Homo sapiens
gcatagctcacttcctcacatctttcaggtctgtacaagtgtcagcttctgaaagagccagtccatctaaaaccgtaaccccttcccctccgcttgtacataccaccaaattcactatagattttacttatttactttttctgcctctccctggcccttaactgcagtagagcaagacttttgttttgctcactcctgtgttcccaatacctaccacaatgccaggcacatggtacatctcaatatttattaaacaaatgcatgaacaaactaagtgaataaataaatgaattctcttttttacaggatcttcttcatgccagccataccgggcaggaaccatcagagagacacactgaggaggcactcagaaaattttgatagaattgaatttacatatagctgataaagcctaaatagaaaggttgatgtatttagcttgaatccttcactttagtggtctaatcaacagataaatgacaagcaaagaatgaaacaatccaaaaatgtttttcaaaacaattttgtgaattttatttttacaaaaattttttaaattcatattttaaaatgtataccaaggcaaaaaaatcatataagctatatcataaatacaagagtttcaaaacatacaagagacatataatgtaaaaaaaaattatatatatgaagtccaatgtaatttataatacaaaaaaatacagcaagggaaaatgctttagaaatgctcatctgcaaactacaaaaca

SEQ ID NO: 287861 - DNA, 2986 bp, Homo sapiens
ggcagaggggggcgcgcgcgcgggcctggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaattcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagca

SEQ ID NO: 287862 - DNA, 2926 bp, Homo sapiens
ggcagaggggggcgcgcgcgcgggcctggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaattttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaattcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagca

SEQ ID NO: 287863 - DNA, 3411 bp, Homo sapiens
agaacgcagaccagcccaagctgacagcttgagtatgccttcttctgctgcctggttttgggggctgtatgacgtactggtcggtagtaaagattaatatgtaagaaatgtggagctaggatcaagtcatactccacagcctgcctggcaaactatgttttacttctgactttgctctctcgctgagaacattaatctgtcaagctggcgggctcctttgatagcaactttcccaggggcatgatgtggcaatgccacctctcagcccaggactaccgctattaccccgtggacggctactccctgcttaaacgcttccctcttcatcctcttacaggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaattcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagca

SEQ ID NO: 287864 - DNA, 3061 bp, Homo sapiens
ggcagaggggggcgcgcgcgcgggcctggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagcagtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaattcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagca

SEQ ID NO: 287865 - DNA, 2806 bp, Homo sapiens
ggcagaggggggcgcgcgcgcgggcctggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggttttaaaaatcaatttgattggccacaggaaacgtattttggcatctctgggagacaggctgcacgacgatcccccacagaagccccctcggtccatcaccctcaggacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaattcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagca

SEQ ID NO: 287866 - DNA, 3153 bp, Homo sapiens
agaacgcagaccagcccaagctgacagcttgagtatgccttcttctgctgcctggttttgggggctgtatgacgtactggacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaattcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagca

SEQ ID NO: 287867 - DNA, 2926 bp, Homo sapiens
agcgggggtaatgaaggggagcgagcgagggggagcaaggagcatggagctgcatactgatgagtgacccagatgccctgtccaaacagtgggacaatggttggaaagcattgggctacctcagtacgagaaccacctgatggctaatggatttgacaatgtgcagtttatgggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatcagtcgtctgtctgtgaaatatggacgaatcagaacgcaggatttcctttctcagcgatccatcaggttcataatacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaattcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagca

SEQ ID NO: 287868 - DNA, 3041 bp, Homo sapiens
ttctctgaggttgacttgaatattatagatttgaagattattaacattattcaacttctgctccttctccaaaaggaagcaatgttatggaagatcaggatttgttggaaattggaatccttaattctgggcacagacaaagaattctacaggcaatccagctccttccaaagatgagacccattgggcatgatggctaccatcccacctctgtagctgagtggctggattccattgaactgggcgactacaccaaagcctttctaattaatggctacacttcgatggacctgttgaaaaaaatctgggaggttgaacttattaatgttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaattcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagca

SEQ ID NO: 287869 - DNA, 2956 bp, Homo sapiens
ggcagaggggggcgcgcgcgcgggcctggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggttttaaaaatcaatttgattggccacaggaaacgtattttggcatctctgggagacaggctgcacgacgatcccccacagaagccccctcggtccatcaccctcaggttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaattcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagca

SEQ ID NO: 287870 - DNA, 2483 bp, Homo sapiens
agggaatgaactttgctgactgctcatattgcctctagaataaatgtcattttcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaattcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagca

SEQ ID NO: 287871 - DNA, 2820 bp, Homo sapiens
gaggaggcccccgcgcgccggcaacccccagtgctaggcgccctgcagcccccgcgcgccgcgcctgggcccgcatcgctctcgcagtgagggtccgcccgagcggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaattcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagca

SEQ ID NO: 287872 - DNA, 2260 bp, Homo sapiens
gtcacggtgaggagttcgggttttgttctgactgactgtgatggaaaccactggagagtgagagccggggagtggcatgcctgattcacctcctccaggaagcccccctggctcccaaggtgtgtgtgcccacatggtgccctctcttcccctcgtatctcacctctcagcactgaaatccgcctctgtctgctccccgtctgtgtgctcacaagggcaagggctgtgccttattcaccgtcaccctcagggtgccctgcagagagtcggtatgcggtaaatgtgtgtccaaagagcgagcccgcgagccgcctagaccagcatcgccgccccgcgcctggggcgaggggcctcgcgtgggttcgccagcggcgtccgcgtgcatgcgcgcacccgcgcggcgaccgtataacaggcatcagcctttctgttttaaagcagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttctgatgactccgccccagtacttgctttgcttcatttggggaaaataataccttttctttaaaaaaaaaaaaaaaaaaaaaagtaaaggggatctctaatactgcctaaaagtatgctttcactgtcagcagttttaaaggtgaaatcagagcagcactacccctcccacctccaaagcatctgtaaaatcattctatcattgagtatcgtttaatgcaaaaggacaaaaacaactcccgtgatatgattgccaggagattctgtttccccatttctatatttgtggattttatatgtaatcacctatgtcagagaaagaaaacctttcaaccaaatgattggttcaaaaggaaagaatgattcaaagcagaggaatttattatgcacagcaaaatgtgtcttgtattaaatatttttattaaaagaatgtttcattaatgcattgataagaaaactaggttagttgcgagggatgtttctggtttcatttcaaataattaaatttctactgctactaccaagaggactggctcagtggtggcaaaatactggtgatgctccctagagcaggaggcccggaagtgctgacgcagccatcagcctgccaagattgttttttaatcttcacagtgttttaaagaacatgttaaaaaaaaaaaaaaatctagtgctcctgctgtcaagatttctgtcatggaaaccttgtttgagaaaggtgttaataaaattctattgcaaaaatttctttttctagaaaaaataaatacaaaaaaaaaaaagaagaaattccaaagtaataaaacttttcttgagacaaacaaaaaaaaagtttgcttactatttgattaaataaaatttacttacatttctttaaggtattttaattttttaatgtctctgtggagtatttgtatgataccataatgtatatttatgtagaatcaaattatataaacagtaccaatatcattatagaaaaattcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataaattttgtaatttttgtcattatttatatcctataaaaaaagcacacaaaaataaaacagaagttgtacagca

SEQ ID NO: 287873 - DNA, 1933 bp, Homo sapiens
ggcagaggggggcgcgcgcgcgggcctggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgatcttcttcatgccagccataccgggcaggaaccatcagagagacacactgaggaggcactcagaaaattttgatagaattgaatttacatatagctgataaagcctaaatagaaaggttgatgtatttagcttgaatccttcactttagtggtctaatcaacagataaatgacaagcaaagaatgaaacaatccaaaaatgtttttcaaaacaattttgtgaattttatttttacaaaaattttttaaattcatattttaaaatgtataccaaggcaaaaaaatcatataagctatatcataaatacaagagtttcaaaacatacaagagacatataatgtaaaaaaaaattatatatatgaagtccaatgtaatttataatacaaaaaaatacagcaagggaaaatgctttagaaatgctcatctgcaaactacaaaaca

SEQ ID NO: 287874 - DNA, 1591 bp, Homo sapiens
ggcagaggggggcgcgcgcgcgggcctggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaatttagcctatgaaatcatcctaaccctgggacaggcattcgaagtcgcttaccagctagcactacaagcaagaaaagggggacactcctccacacttccagaaagctttgaaaacaaaccctccaaacccatccccaagccccgcgttagcattcgcaagtccgtgagatcgacccatctgagcaaaagactctggccaatctaccgtggattgtggagccgggccaagaagccaagaggggcattaataccaagtatgaaaccacgattttctgatactcgccgtcctcctgtcctcgcggtgccttgctcgccaagcggtcccggagcaggctttccttcgcgcctccgcgtccacccagcccaggaggaagactgctctgagcgtgcggccttgttacgggcgaaaggccactggccattcctggggaagttctttctgcaccagtgatggaaaacgcaagactttccagtcgcaacccctgagaggcgtgagttgagatgggttttccctgatgctcccgactcccctccccaccacctcccaaggtatttttctttctttctctctctttttttttttttttttttt

SEQ ID NO: 287875 - DNA, 1055 bp, Homo sapiens
ggcagaggggggcgcgcgcgcgggcctggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtggtgagtacccaccccctttcaacagattaaagactttgcagaatgggcctggactgta

SEQ ID NO: 287876 - DNA, 1088 bp, Homo sapiens
ggcagaggggggcgcgcgcgcgggcctggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaagacctctcaacatttgcctatatcacaaaagatttgaagtctaatcaccactactgtcatgtgtttactgcctttgatgtgaagttagcccgcatttttgcacaagcatcttgggttgattctgtccccctaagctcttttatcagcatagaacctctgcaaggaacccacg

SEQ ID NO: 287877 - DNA, 1060 bp, Homo sapiens
ggcagaggggggcgcgcgcgcgggcctggggagctcgcggggagagcccggcgctcggcgcagcgcggcgcggccaagctccgcgcctctcccgcccttcctcggcgcgctcgccctcgcctcgccgctcgcattcgctgggggcgcccagaaagatgcacagaggcaacggctaggggagcggaggttcaagccacatgtctgcgtcctcgggggccagagcccgccagccctcgcggatcccggctcgcggccagcccgagcggctcgggttttaaaaatcaatttgattggccacaggaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcagacaggagactggggagaaccttccattaccttgcgacctccgaatgaagccacagcctctaccccggtacagtactggcagcatcacccagaaaagcttatcttccagtcgtgtgattacaaagctttttatttaggttctatgctgataaaagagcttagggggacagaatcaacccaagatgcttgtgcaaaaatgcgggctaactgtcagaagtctacagagcaaatgaagaaggtccctactattattctttctgtctcatataaaggagtcaaatttattgatgcaacaaataagaacataattgctgagcatgaaattcgtaatatctcctgtgctgcccaggacccagaaggtccaggtatgccagaaggtccaggtatgccggaaggtccaggtatgccagaaggtccaggtatgccagaaggtccaggtatgccagaaggtccaggtatgcagaaggtccaggtatgccagaagtccagaatgccggtccgc

SEQ ID NO: 287878 - DNA, 468 bp, Homo sapiens
ctttaggaaaacagaacctgactcttgatatttcagacctttgacctgaaatacttaggggaaaaacgtattgactagatcatgccattaataaagtggtggaatgtcattcattccttggctgttgcttcaaaagcgactccccacccccacagtttgtcttgtcagtatttcacaattttgaaaccaaaggttagccacagaacatggtatttatttcatgatgtatttccattcaggaacccagtggtaatcacactcctcctcagttgtctccatcacttagccaaagcacttacaccactggtggctccctagacgttcctcacattatcatgcagggcgatgcaaggaggagaagaaatgaaaactactttgatgatattccccgatcaaaactggagaggcagatggctcaggtaaggtgttataagcctttgtgatatttttcaaccatatcaggtaatg

SEQ ID NO: 287879 - DNA, 464 bp, Homo sapiens
tataaacagtaccaatatcattatagaaaaaaataacattttaatgtatattgttctaacaatcatattgtgaatcattttgaagttcattatagcgatattgataaattgtggaattgtcttaatgtttttttattaactgacattattttaaacctaactgagatgatcagttacattcatcagttggtgagttttgaagaataactacattttatttcaaactaacaaatgtatacggttttagttcagtgttgaagaattttaatacaatattaaattacttgaactgaacagttccttgtatatattttgcctattcactgttgatatgtatgtagcaaaatgagagttaaataacactaaaatatggtaccaggaggcaattgtataggagcaaagttaataggagctttgctgaaacagaagcatatgtgtaaataagcttgggcttccagttataa

SEQ ID NO: 287880 - DNA, 1466 bp, Homo sapiens
  misc_feature (1394)..(1394): n is a, c, g, or t
  misc_feature (1427)..(1427): n is a, c, g, or t
ttttttttttatagctgctgttaccttttattgagtacccacaatgtgctaggcaactgtgctagatacttttacataatctcatttaatttaaccctcacaacaaccctgtgaggtaggtatttgctccattttacaaatggagaaatcgaggcacaaaagattaaacatcttaccaaagtctgcacagccacttatatgctggagctagaatttgaacccaggtgtgcctccactttttaatactagaccaatcttttcacgggggaagtttcctagattaacaccctcacatcttttaagaccattccaaaacctgcgttctgttttgcagaagccctcactgtgtttctgctgccctgaaacagtggaggcagacaaaggtgagtgccaagtgaggaaccataagaagtggtagatctctgtggagtgccataagaaccctcaagagccttaacaaaggtagttgggggagaggggaagaggtgtttcagcagctctgctcccagcagccatttcctctctccagggcaaaggggtggggctgcgaggccagctgaccaagaaacccctccagctcctccagtccaagtccagcatctttcctacaactattctgccttccacttcgtcttcttccttgcctcactctatgtcatggttacccttaccaactggttcaggtaagatggagtgggccttagatactctcctgaagagctagctattttaaggaaagagcaattcaaggccattccagacacacatgggtctgccattatatttggtgaggaggtagaacaggtctaaaagctaaggcccttcatattctctaaccagagcctttggttacacagctatgagggagcagaactggaaaagaccttcatcaagggtagctgggccaccttctgggtcaaggttgcctcatgctgggcctgcgtactcctctatctggggctgttactggcaccactctgttggccccccacccagaaaccccagccccttatcttgaggcgccgccgccaccgcatcatatccccagataacaaatatcctccagtctaagtccttttcacaaactggggttcccctgacattgtactcctagagttggctcaaggggagctgtccagcccagctcaatacctcaaggacacacagggagttatctccgtttgggctgaagtcaatactatgaactggaagaagtggtcaaacacagtctaatgtgctgggcagagtgtctgactcactggagctactgttacatctgcatcccagctcaagagcctaacacccaaatcagcagctcaaagaaccaccgctgatcccagcagacagtgtggcaccagccctttcctggctcttgggcttcttatatccgtgtnccagggctgaactccttattttcctttctccanaggcagagccgagtcttcagtccctgttggtctttcccc

SEQ ID NO: 287881 - DNA, 1541 bp, Homo sapiens
  misc_feature (1469)..(1469): n is a, c, g, or t
  misc_feature (1502)..(1502): n is a, c, g, or t
ttgtgtgcccacctgtttggcctctctgactgtccagtgctcagtggctctggggctgtgtaccgagtatgtgcaggaaccgccaccttccacctgctgcaggctgtgttgctggtccacctccactcccccaccagcccgcgggcacagctgcataatagcatggcattacattggcatctgtggaggctttgcattcatcctactgcagttggtgcttattacagcttttgcccattcctggaacaagaactgagcaaccccgctctggcctcctacaagcttctgtcatcagctgctatatcatgtatctgactttctctgcactgtccagccgtcctccagagagagtaatccttcaaggacagaatcacaccctgtgcctgcctggcctgagtaaaatggaaccccaaacaccagatatctctctagcaatgctgagtgctagcatcatgtatgcttgtgtgctttttgcttgcaatgaggcctcctacctggctgaggtatttggacccctgtggattgtcaaggtttacagctatgagtttcagaagccctcactgtgtttctgctgccctgaaacagtggaggcagacaaaggtgaggcaaaggggtggggctgcgaggccagctgaccaagaaacccctccagctcctccagtccaagtccagcatctttcctacaactattctgccttccacttcgtcttcttccttgcctcactctatgtcatggttacccttaccaactggttcaggtaagatggagtgggccttagatactctcctgaagagctagctattttaaggaaagagcaattcaaggccattccagacacacatgggtctgccattatatttggtgaggaggtagaacaggtctaaaagctaaggcccttcatattctctaaccagagcctttggttacacagctatgagggagcagaactggaaaagaccttcatcaagggtagctgggccaccttctgggtcaaggttgcctcatgctgggcctgcgtactcctctatctggggctgttactggcaccactctgttggccccccacccagaaaccccagccccttatcttgaggcgccgccgccaccgcatcatatccccagataacaaatatcctccagtctaagtccttttcacaaactggggttcccctgacattgtactcctagagttggctcaaggggagctgtccagcccagctcaatacctcaaggacacacagggagttatctccgtttgggctgaagtcaatactatgaactggaagaagtggtcaaacacagtctaatgtgctgggcagagtgtctgactcactggagctactgttacatctgcatcccagctcaagagcctaacacccaaatcagcagctcaaagaaccaccgctgatcccagcagacagtgtggcaccagccctttcctggctcttgggcttcttatatccgtgtnccagggctgaactccttattttcctttctccanaggcagagccgagtcttcagtccctgttggtctttcccc

SEQ ID NO: 287882 - DNA, 1145 bp, Homo sapiens
  misc_feature (1073)..(1073): n is a, c, g, or t
  misc_feature (1106)..(1106): n is a, c, g, or t
ttgtgtgcccacctgtttggcctctctgactgtccagtgctcagtggctctggggctgtgtaccgagtatgtgcaggaaccgccaccttccacctgctgcaggctgtgttgctggtccacctccactcccccaccagcccgcgggcacagctgcataatagcatggcattacattggcatctgtggaggctttgcattcatcctactgcagttggtgcttattacagcttttgcccattcctggaacaagaactgcaatgaggcctcctacctggctgaggtatttggacccctgtggattgtcaaggtttacagctatgagtttcagaagccctcactgtgtttctgctgccctgaaacagtggaggcagacaaaggtgaggcaaaggggtggggctgcgaggccagctgaccaagaaacccctccagctcctccagtccaagtccagcatctttcctacaactattctgccttccacttcgtcttcttccttgcctcactctatgtcatggttacccttaccaactggttcaggctatgagggagcagaactggaaaagaccttcatcaagggtagctgggccaccttctgggtcaaggttgcctcatgctgggcctgcgtactcctctatctggggctgttactggcaccactctgttggccccccacccagaaaccccagccccttatcttgaggcgccgccgccaccgcatcatatccccagataacaaatatcctccagtctaagtccttttcacaaactggggttcccctgacattgtactcctagagttggctcaaggggagctgtccagcccagctcaatacctcaaggacacacagggagttatctccgtttgggctgaagtcaatactatgaactggaagaagtggtcaaacacagtctaatgtgctgggcagagtgtctgactcactggagctactgttacatctgcatcccagctcaagagcctaacacccaaatcagcagctcaaagaaccaccgctgatcccagcagacagtgtggcaccagccctttcctggctcttgggcttcttatatccgtgtnccagggctgaactccttattttcctttctccanaggcagagccgagtcttcagtccctgttggtctttcccc

SEQ ID NO: 287883 - DNA, 786 bp, Homo sapiens
  misc_feature (10)..(10): n is a, c, g, or t
  misc_feature (41)..(41): n is a, c, g, or t
  misc_feature (714)..(714): n is a, c, g, or t
  misc_feature (747)..(747): n is a, c, g, or t
cggtcagganaggcaggcacagggtgtgattctgtccttgnaaggattactctctctggaggacggctggagtaaaatggaaccccaaacaccagatatctctctagcaatgctgagtgctagcatcatgtatgcttgtgtgctttttgcttgcaatgaggcctcctacctggctgaggtatttggacccctgtggattgtcaaggtttacagctatgagtttcagaagccctcactgtgtttctgctgccctgaaacagtggaggcagacaaaggtgaggcaaaggggtggggctgcgaggccagctgaccaagaaacccctccagctcctccagtccaagtccagcatctttcctacaactattctgccttccacttcgtcttcttccttgcctcactctatgtcatggttacccttaccaactggttcaggagttggctcaaggggagctgtccagcccagctcaatacctcaaggacacacagggagttatctccgtttgggctgaagtcaatactatgaactggaagaagtggtcaaacacagtctaatgtgctgggcagagtgtctgactcactggagctactgttacatctgcatcccagctcaagagcctaacacccaaatcagcagctcaaagaaccaccgctgatcccagcagacagtgtggcaccagccctttcctggctcttgggcttcttatatccgtgtnccagggctgaactccttattttcctttctccanaggcagagccgagtcttcagtccctgttggtctttcccc

SEQ ID NO: 287884 - DNA, 176 bp, Homo sapiens
agtaacaatttgacatttttccactggtgcccatcttgcagcatggcattacattggcatctgtggaggctttgcattcatcctactgcagttggtgcttattacagcttttgcccattcctggaacaagaactggtaaggggcacataaccctaaagcttttcctggggagtttc

SEQ ID NO: 287885 - DNA, 210 bp, Homo sapiens
caatttgacatttttccactggtgcccatcttgcagcatggcattacattggcatctgtggaggctttgcattcatcctactgcagttggtgcttattacagcttttgcccattcctggaacaagaactggtaaggggcacataaccctaaagcttttcctggggagtttctagtattactacatggaaagggctgggcaaaaggcacgg

SEQ ID NO: 287886 - DNA, 340 bp, Homo sapiens
ggaaaaggtgagtgggaaaaataattttcctttttagaaattattgagggtgggggccgggcacggtggctcacgcctatgatcccagcacttcagaaggccaaggcgggtggattacctgaggtcaggagttcaagaccagccttgctaacaaggtgaaaccctgtctctactaaaaatacaaaaattagccaggtgtggtggcacacccctgtaatcccagctactcgggaggctgaggcaggagaattgcttgagcccgggaggcagaggttgcagtgagtcgagatcgtgccactgcactccagcctggctgacagagcgagactgtctcaaaaaa

SEQ ID NO: 287887 - DNA, 536 bp, Homo sapiens
ttgaaatactctttcttcacctagggtctcttctcagaaaacaaagaaaaactgatcaataatgccataacagcattactgtcccaagaaggggatgtcgttgcttcaaatgcggaacttgagagtcagttccaggctgtgaggaggcttgtggcatccaaagctggtttcctggctttcactcagcttccaaagtttcgcgagcgtctaggggtgaaggtagtaaaagcactcaaaagaagcaacaacggaataatccatgcagcagttgatatgctttgtgcccttatgtgtcccatgcatgatgactatgacttaagacaagaacagttgaacaaagcttctcttctctcgtcaaagaagtttctggaaaacttactggagaaatttaattcccatgtggatcatgggactggtgccctagttattagttcgctcttggacttccttacctttgccctctgtgctccatatagtgagacaactgaagggcagcagtttgatatgctcttggagatggtagcatccaatggaag

SEQ ID NO: 287888 - DNA, 2553 bp, Homo sapiens
ctaaaggccttgcacaacatcagagagttcatactggagagaaccttacacatttcacgagtatggaaagacctttgctcaaaattcagcccttgtaatgcataaggcaattcatactggaaagaaaccttacacatgtaatgaatgtggcaaggtttttagtagaaaagcacaccttgcatgtcatcatagacttcatactgtctaaggtttctaatcaacaatcaaaccttgcacaacatcagagagtttatactggagagaaaccttacaagtgtaatgagtggggcaaagccttaagtgggaagtcgtcacttttttatcatcaagcaatccatggtgtagggaaactttgcaaatgtaatgattgtcacaaagtcttcagtaatgctacaaccattgcaaatcactggagaatccataatgaagacagatcttacaagtgtaataaatgtggtaaaattttcagacatcgatcatatcttgcagtttatcagcgaactcatactggagagaaaccttacaaatatcatgactgtggcaaggtcttcagtcaagcttcatcctatgcaaaacataggagaattcatacaggagagaaacctcacaagtgtgatgattgtggcaaagtcttgacttcacgttcacacctcattagacatcagagaatccatactggacagaaatcttacaaatgtcttaagtgtggcaaggtcttcagtctgtgggcactccatgcagaacatcagaaaattcatttttgagataactgttccaaatacagtgactatagaagatcataaagctttaattgacattagagccaaataggcattgacttgagattgagttgacttaaccttgagtttaagaattaatttacattaaagtgtttatgttaagaagattgggccaggtgggattacaggcgcgagcaccgcgcccggcccctaagttaatatttcaaacaatcgaaggtaaaacaacatattgtgttgggccacctgtactgaacgctgaatcgtttttcctcttaagttgaaaatggttttaatgcaaagcgcctttttttgagcaggtagagtcacgcatccggcaggcggggcgagctcccctctgtctggggcagggtgggggagaggggcagggacctcggtaaaggggtggagtggcgcgctggttgccgcgggcactggcaattagaagggattattaaactaagcaaggtcctgggttgtttgagtggataatggaaactgaaaggtgacgtgcaaaactgcctattactcccaggagtggaggataatttcatatttcatggaaataaactcagggcccggagcggtggctcacacctgtaatcccagcactttgagaggccaaggagggaggatcgcttaagcccaggaattcgaaatcagcctaggcaacatagtaagacctcatctctactaaaaataaaaaaaaacagccaggtgtgttagtccacacctgtggtcccagctgcctcagcttcccgagtagctgggattacaggtatgaaccactatgcccggctaactttgttttttttttttagaaattaaaccttttttcagcttaatgacccaggggtgtatttttgaaggacttgggagctctctttgaaaggcaaacaacaagggaaacagtacctttatctcagtaggaaattaaataattcaaacatcaaataacttcaatttaaggctatggactttgagataattctgagccttgagaggaatgtggtcaggcaacctgagtccagtggaatgcaggtgcaacttctaagagttttcctgtaagtaattaagaagactaagtagccccagagataagacctcctcggatcattgtcccttcttatgtagtgataaagtaaccttccttgaagtgtatctatccgtaatcaatcaagttgctgcagcctatgcactggcccagaataaaaaacgtggtgattctgctaaagcttctctgtctttccctgtgtgtgaaatcttaacgtctctacttgggaacgctgatcccattcatttagagttgatgtttccacgtggctatttccaagctttgccttcaaataaattctgtacttaatcatatattctaaattttattatttactgctgacatcagtttctgtcggattgtaggagcctcaccagagagggcccctgtcgccatgttgtaaaactcacacttgccaaaagttgtgggttagggtttctccccctccctcaggatgacgctagttagctgacacagatggtcacctccattaccaagtagagtcaggatgaactatgtgtgactgttcaactatgtgtcctcttccctgaggactgattagtgtttatcttgaaaacatgtccttaatgggttgtatagaacactgaagcatctgatttcaaactcttagctcttttcctctatttcccatcacattctggtctaaggcttatttattaataaaatgatttttatttctttaaacaaaaaaaactttagagcacactggggtaccggatc

SEQ ID NO: 287889 - DNA, 4263 bp, Homo sapiens
acacatccgcgcagaccaggaagcggatcccgtggattgaaggtcgcaccgcggcggattgacttctaaagacttggtacgtgaggaaaaaacacggaagaggaagaggaaagcaaaggagtcagggatggctcttcctcagggtctactgacattcagggatgtggccatagaattctctcaggaggagtggaaatgcctggaccctgctcagaggactctatacagagacgtgatgctggagaattataggaacctggtctccctggatacctcttccaaatgcatgatgaagatgttctcatcaacaggacaaggcaatacagaagtggtccacacagggacattgcaaatacatgcaagtcatcacattggagatacttgcttccaggaaattgagaaagatattcatgactttgtgtttcagtggcaagaaaatgaaacaaatggccatgaagcactcatgacaaaaatcaaaaagttgatgagtagtacagagcgacatgatcaaaggcatgctggaaacaaacctattaaaaatgagcttggatcaagctttcattcgcatctgcctgaagtgcacatatttcaccccgaagggaaaattggtaatcaagttgagaaggccatcaacgatgctttctcagtttcagcatcccaacgaatttcctgtaggccaaaaactcgtatttctaataagtataggaataatttcctccagtcttcattactcacacaaaaacgggaagtacacacaagagaaaaatctttccaacgtaatgagagtggcaaagcctttaatggtagctcactcttaaaaaaacatcagataatccatttaggagacaaacagtataaatgtgatgtatgcggcaaggactttcatcagaagcgataccttgcatgccatagatgtcacactggtgagaatccttacaagtgtaatgagtgtggcaagacattcagtcacaattcagccctgttagttcacaaggcaattcatactggagagaaaccttacaagtgtaatgaatgtggcaaggtttttaatcaacaatcaaaccttgcacgtcatcatagagttcatactggagagaaaccttacaaatgtgaagaatgtgacaaagttttcagtcgcaaatcacaccttgaaagacataggagaattcacactggagagaaaccatacaaatgtaaggtttgtgacaaggctttcagacgtgattcacacctggcacaacatactgtaattcacactggagagaaaccttacaagtgtaatgagtgtggcaagacctttgttcaaaattcatctcttgtaatgcataaggtcattcatactggagagaaacgttacaagtgtaatgaatgtggcaaggtttttaatcacaaatcaaaccttgcatgtcatcatagacttcatactggagagaaaccttacaagtgtaatgaatgtggcaaggtttttaatcgaaaatcaaaccttgaacgtcatcatagacttcatactggaaagaaatcttagaagtgtaaatttgcaaggtttttaggcaacagtcaaaccttgcatgtcatcatagactttatactggagagaaaccttacaaatgtgaagaatgtgacaaaagttttcaatttcaaatcactccttgaaatacataggagagttcatactggagagaaaccatacaaatgtaaggtttgtgacaaggatttcgggtgtgattcacacctggcccaacatactggaattcacactggaaaggaactgtacaagtgtaatgagtgtggcagagcctttggtggtcagtcaacacttactcaccatcaagcaatccatggtatagggaaacttgactaatgtaatgattgtcacaaagtcttcagtaatattacagccattgcaaaacattggagaatccataatgaaggaggtcttacaagtgtaataaatgtggcaagtttttcagacatcattcataacttgcagttcattggcgatcttatacaggagagaaatcttacaaatgtgatgattgtggcaaggtcttcagtcaagcttcatcttttgcaaaacgggagaattcatacaggagagaaacctcacaagtgtgatgattgtgagcaaagcctttacttcacgttcacaccacattagatatcagaggatccatactggacagaaatcttacaaacgtcctatgtgtggcaaggtcttcagtccgaggttactccttgcagaatatcataacgttcatttttgaggtaatagttacaaatgcggtgagcacagcaaaccatcaaggattgacagtagagtcaattcagaattgacttgagtttgagttgacttaaaacattcagttgaagcattaattgacattaaagtgtttatgttaagaggattgggccaggcgtgtggctcacgcctgtaaacccagcactttaggagcccaaggtggatagatcacttgaggtcatgagtttgagatcagcctggccaacagacgtgagtcacttttcccagcctgctttttgtttctttaacaaaaaccaataggggtttttataggtattgtgttgaatctgaatcacattggcttatataataacaatattgatttttccaaaccatcaatgtgggttgtatatatatgtttttaatcattttggttaatgtttgtagatttcaaggtgtgaaattctcagtttttttatgtttattcctaagtatttcttactttaagatctctagcaaatggaagtgttttttaattttcgtttaaattttttattgtttatggaaattcaattaatttttggtgctgctattgcattgtgcaaatccactgaatgtgttgattagttccagctgcttggggtgctgaggtgggaggatcacttgagccagaaagttggaggctgcagtgagctctgatcttgccaccacactccagcctgggtgaaaaagctagaccctgtctcaaacaagcaaataaatgagaggtataagtcctcctttaaaagtaaaggaagagatttttctttccttttgtctcttagaacattcaattagaaaatttgtaaattcattgtctctgtcttctgaggtttttttttttagacagagtttttctcttgttacccaggcttgagtgcaagccacgatctcgcctcaccacaacctccgtctcccgagttcaagcgattctcctgcctcagcttcccgagtagctgggattacaggtatgaaccactatgcccggctaactttgttttttttttttagaaattaaaccttttttcagcttaatgacccaggggtgtatttttgaaggacttgggagctctctttgaaaggcaaacaacaagggaaacagtacctttatctcagtaggaaattaaataattcaaacatcaaataacttcaatttaaggctatggactttgagataattctgagccttgagaggaatgtggtcaggcaacctgagtccagtggaatgcaggtgcaacttctaagagttttcctgtaagtaattaagaagactaagtagccccagagataagacctcctcggatcattgtcccttcttatgtagtgataaagtaaccttccttgaagtgtatctatccgtaatcaatcaagttgctgcagcctatgcactggcccagaataaaaaacgtggtgattctgctaaagcttctctgtctttccctgtgtgtgaaatcttaacgtctctacttgggaacgctgatcccattcatttagagttgatgtttccacgtggctatttccaagctttgccttcaaataaattctgtacttaatcatatattctaaattttattatttactgctgacatcagtttctgtcggattgtaggagcctcaccagagagggcccctgtcgccatgttgtaaaactcacacttgccaaaagttgtgggttagggtttctccccctccctcaggatgacgctagttagctgacacagatggtcacctccattaccaagtagagtcaggatgaactatgtgtgactgttcaactatgtgtcctcttccctgaggactgattagtgtttatcttgaaaacatgtccttaatgggttgtatagaacactgaagcatctgatttcaaactcttagctcttttcctctatttcccatcacattctggtctaaggcttatttattaataaaatgatttttatttctttaaacaaaaaaaactttagagcacactggggtaccggatc

SEQ ID NO: 287890 - DNA, 827 bp, Homo sapiens
tactgcaatgtaagaagtgcttttcacctcctgccatgattctgaggcctccccagccatgtggaactgttcaatttctggttggtaattggcaatgatggaatgactgtccggagtaaagaagcctctctttgttcttgtgccatgatttcccagccaggcagtgcttgcagttcactggactgatcattttctttcacactctgtgcctttgcaaatattattcttttgtctgaaaattgcctgctcccaacccttcattatcatccccactaactctcacccaccctccccagcttgttgacttggaaactccttctttttttaccagctgcaattcaagcaacacctcctctggggagccttttcaactctgccttagtcttttttggccctagtttttgcatctctccagattcactgggctttctctgctttctgggtcacttgttcagtgaagaacccctaccccatcatcaccacaactcttaaccctaccacccttagccctttccagatgagggctgtgctctagcatggctccttcatactcaccatgatgggactgcaaagaccctggtgtctggggcctgaacccactgggcccctgaagttcagcttcctgcagcattcccagaatctgaggaagcaccgtgaaccgaggtctgggctctgacttccctgatcctggagccaggtcatccaatctgtaaatgtaaaggatggaattatttttaccaatgaggaacagctggaggcctcagatatgaatattcaggattggtgaaagaactcaacaatttgactgagtgtcataattgtggcac

SEQ ID NO: 287891 - DNA, 1393 bp, Homo sapiens
tactgcaatgtaagaagtgcttttcacctcctgccatgattctgaggcctccccagccatgtggaactgttcaatttctggttggtaattggcaatgatggaatgactgtccggagtaaagaagcctctctttgttcttgtgccatgatttcccagccaggcagtgcttgcagttcactggactgatcattttctttcacactctgtgcctttgcaaatattattcttttgtctgaaaattgcctgctcccaacccttcattatcatccccactaactctcacccaccctccccagcttgttgacttggaaactccttctttttttaccagctgcaattcaagcaacacctcctctggggagccttttcaactctgccttagtcttttttggccctagtttttgcatctctccagattcactgggctttctctgctttctgggtcacttgttcagtgaagaacccctaccccatcatcaccacaactcttaaccctaccacccttagccctttccagatgagggctgtgctctagcatggctccttcatactcaccatgatgggactgcaaagaccctggtgtctggggcctgaacccactgggcccctgaagttcagcttcctgcagcattcccagaatctgaggaagcaccgtgaaccgaggtctgggctctgacttccctgatcctggagccaggtcatccaatctgtaaatgtaaaggatggaattatttttaccaatgaggaacaggtagactcttacgcctttctccccatgccctatccccaccctttacagactgtgaaagcacacagatttctacttacagactgttctgaagcacatcgatttccacacgactgactggagacatctagtgtgatcgagacctcagctgtgtgttataatcaatgtgccacctttgcttccccctctgctctcattcttgctgctcaataacaccggaactctgctccaggttctcatttctatgcaagtgtagaaatcctctacaatctcctagcaacacaggcataccgctaccctagcttgaaataacctgagtcatgattgttagtttactttaacagagattcttgattgcagaggaactttttttcagtggtctcattacttagcaccatgttgggaacatagcaggtgactcaatcaacagtttttaattaattaatggctttaacattaaataattatagaacacatttaaaacaaaaagagctcttagacatttttgctttaattctctgtgtgatatggagaaactgcctgaggccaggagaattaaggtactttccagagtcatgcagctattgagtagccagactggagatggcatattggtttcctgatcacacagcactattctctttt

SEQ ID NO: 287892 - DNA, 400 bp, Homo sapiens
gcaggagcctgtcatcagtaagagttgatggatgtttgagtggagaggggcagtgaggggtggacaaggggactggagcgggaggcattgtggcactgagccggccaggcctgctgactagctcttcctgtgtacttatgtctgtctgtggctggtttccctccagcacagacctttcctgtctcaggaaatagcactgttgtgcccccagggctgagcttctgcctggcacatggttagcacttagtgaacgtttctgaatgaatgggaaaatgctctccctttggaggagtggccagagtgagttggccacgtctctgtcctgagggaaagacggcggcaaggctgactcctgaggtcccatcgatcccgcctgcgtttcccatttgttcttatttat

SEQ ID NO: 287893 - DNA, 2248 bp, Homo sapiens
  misc_feature (2)..(3): n is a, c, g, or t
  misc_feature (1921)..(1921): n is a, c, g, or t
  misc_feature (2246)..(2246): n is a, c, g, or t
tnngtagcgctcccttttgggatcaacgagctgtgtggcgcctgtgcggcttctgagagaccggctggtggcgcttggcggcttcctgccaatccacccttctcctcccgcgcaagggggcaatcccaatcccaccaccgggaacacccaggccaaaagaacgggagttacactcaaagtcttcccccttcttatcactcctgccgatttccctcttcctttttgcacgcctccactcttccccaccggaaacgccgccccttcctcctacagttcctcccagcagtccctcaacgcctgtcttccctcgcgcgtagagagtgactcgaaggaccccctctcctcttcgctgcagcccctccccatgcacgctgggagactcttggaggggataaggtggggcccggagaggaagagaagacaatcggattggataggcagctgccatggcaactggaggctgtggttatattgtcatagtaaccgatgtgtgcggacagggtcaccctccccttggccaatggattcccaggaaaccacccagggttccccgttggcttcccttccatctaaaggcctcccccaagttaggaatcgatatagttctccccggtggtgaagtccacttcctcctcccttcccacttcccacagcaactggggggacaccccgaggcattcaccatgggcttttccacccgcctgcgagcgggaaccacctccgtagtttcctctcagagccgggcgtggagagggctgggcctgcgaagaggatgcatggcctggaggctggcgggcggcgggctggagtcgggagggcgaggcgacagcgccaagcggcgaggaagggcaaggggtttccccacaactgccttgggctctgggaggcgggatcccgcctggacggggtccctgagggaggagagcggcacacgacagccgcgatgccttccctgccgacggggatagccgacttctggcgagtcgacccctcccccaaatccaccccacccgcgtactccctcctgacctagctgtcgcgagcctgccgcgaggaggccagggtgagggtgggaacacatcctagaaggctaacacgtggttttctatcatttaagccggggacaagccggaaggctgactagcgccatcactctgataggcaccccgcagtggggatcctgcttgattattaaaggcagacctccaagttcctccctgctctgcaacctttctcttctcacgggtctgcagtgttttaaaagtcgtcattctgtgtcgttgagttagagaggaaaacatcggataaaagaggatcaagaagaacgaaccctagatacatctgtctggtgaaaggagtctaggaaaagaagtttcattcttagaacaaatctttttggatatttattatgtgtgttttgtgtcaggtttcgggccaaaaagctgaaataaagaacgaagtcaataataatatgaagtgtatgagaaatagctggaaaattcatcatccatgacttgaagaaattgacgttttacaagttatattttcggttcgtattgtggagtcacttaaggagctatcccaaagtactttaggatatgtaactatataaaaccttccaagaatgcagccctcataggatagttaaaataaggattttaatgggctattttgatttggtttggtctggtttggctacctgattcctgctgtctttttctacgccaggtgaagaggcactttcaagatccttctctgagacctgcaccaataagactataccaatgttcagttgaaacatcaggtataagtttagcggaaacgaaagtacaacctgctttgaaataaattccaaggacagattgtcattaacgaaatagaaagtggactatgcccctcatgctgccagcgcctggtatgntgcggcgtgacacgcagcgcttgcggcagtacaatgcccccaatcacccgccccgccccgacgcgccgcccactcacggcaaagagagccacctagtgagggattattctcatttccgcggtggggttctgcttttctttctaccatgagcgcccaaggatagacactcctactacctattacctcaaatagcctacatttctttccgaaaatttattggttagatatttttctttttttttttaatttaaagaccagtgtgatcgtgtattggttagattttttaattggttagatttcaaccagaataaaaattgtaataatnac

SEQ ID NO: 287894 - DNA, 2602 bp, Homo sapiens
  misc_feature (2)..(3): n is a, c, g, or t
tnngtagcgctcccttttgggatcaacgagctgtgtggcgcctgtgcggcttctgagagaccggctggtggcgcttggcggcttcctgccaatccacccttctcctcccgcgcaagggggcaatcccaatcccaccaccgggaacacccaggccaaaagaacgggagttacactcaaagtcttcccccttcttatcactcctgccgatttccctcttcctttttgcacgcctccactcttccccaccggaaacgccgccccttcctcctacagttcctcccagcagtccctcaacgcctgtcttccctcgcgcgtagagagtgactcgaaggaccccctctcctcttcgctgcagcccctccccatgcacgctgggagactcttggaggggataaggtggggcccggagaggaagagaagacaatcggattggataggcagctgccatggcaactggaggctgtggttatattgtcatagtaaccgatgtgtgcggacagggtcaccctccccttggccaatggattcccaggaaaccacccagggttccccgttggcttcccttccatctaaaggcctcccccaagttaggaatcgatatagttctccccggtggtgaagtccacttcctcctcccttcccacttcccacagcaactggggggacaccccgaggcattcaccatgggcttttccacccgcctgcgagcgggaaccacctccgtagtttcctctcagagccgggcgtggagagggctgggcctgcgaagaggatgcatggcctggaggctggcgggcggcgggctggagtcgggagggcgaggcgacagcgccaagcggcgaggaagggcaaggggtttccccacaactgccttgggctctgggaggcgggatcccgcctggacggggtccctgagggaggagagcggcacacgacagccgcgatgccttccctgccgacggggatagccgacttctggcgagtcgacccctcccccaaatccaccccacccgcgtactccctcctgacctagctgtcgcgagcctgccgcgaggaggccagggtgagggtgggaacacatcctagaaggctaacacgtggttttctatcatttaagccggggacaagccggaaggctgactagcgccatcactctgataggcaccccgcagtggggatcctgcttgattattaaaggcagacctccaagttcctccctgctctgcaacctttctcttctcacgggtctgcagtgttttaaaagtcgtcattctgtgtcgttgagttagagaggaaaacatcggataaaagaggatcaagaagaacgaaccctagatacatctgtctggtgaaaggagtctaggaaaagaagtttcattcttagaacaaatctttttggatatttattatgtgtgttttgtgtcaggtttcgggccaaaaagctgaaataaagaacgaagtcaataataatatgaagtgtatgagaaatagctggaaaattcatcatccatgacttgaagaaattgacgttttacaagttatattttcggttcgtattgtggagtcacttaaggagctatcccaaagtactttaggatatgtaactatataaaaccttccaagaatgcagccctcataggatagttaaaataaggattttaatgggctattttgatttggtttggtctggtttggctacctgattcctgctgtctttttctacgccaggtgaagaggcactttcaagatccttctctgagacctgcaccaataagactataccaatgttcagttgaaacatcagacactgttctggttatgatggacaccacagtgaaagagacctggtccctgccttgaggaaacccaactgctggtagagagctcagagtaatgattaggatgcaatatgagggatgcagtaattgggatctacttctgggaaccgtcacagcctgagaaagatggcatgccctgaatggaattcacagagaattattttaagtcatgctactggccccgcccagttatgtaacaacttgcatttcctcaattctctggaatgtggccagtcaggaacttccacatttggttttttttttttcccccatttgtgggtaagaaagtaaaagaggcaggaaaactgaattgagaaagaagaaagaataggggaagagagaaagaaaaaagaaaaccatgaagcctggaagaggagaaagaagagatagatgagcaaagaagcacattgcctggtggtagtaatagttgtcagacacccatctattataatctgttttccatgggagattttaagaagaggctagatccccagtctgtcttaaaatcaagaaaagggactctgttgcctctaaagtatacttccagactcagcaatctctaaattctgagtggggcatccctagttttgctgcctaaaatctatgacagttggaaatgattccatttaagatccagttcaagaagctatacaccctgaggaactttatattgccatttagaggaccgatattctccagattgcttgagcccaggagtttgagaccagcctgggcaacatggcaaaactccatctctaccaaaa

SEQ ID NO: 287895 - DNA, 2026 bp, Homo sapiens
  misc_feature (2)..(3): n is a, c, g, or t
tnngtagcgctcccttttgggatcaacgagctgtgtggcgcctgtgcggcttctgagagaccggctggtggcgcttggcggcttcctgccaatccacccttctcctcccgcgcaagggggcaatcccaatcccaccaccgggaacacccaggccaaaagaacgggagttacactcaaagtcttcccccttcttatcactcctgccgatttccctcttcctttttgcacgcctccactcttccccaccggaaacgccgccccttcctcctacagttcctcccagcagtccctcaacgcctgtcttccctcgcgcgtagagagtgactcgaaggaccccctctcctcttcgctgcagcccctccccatgcacgctgggagactcttggaggggataaggtggggcccggagaggaagagaagacaatcggattggataggcagctgccatggcaactggaggctgtggttatattgtcatagtaaccgatgtgtgcggacagggtcaccctccccttggccaatggattcccaggaaaccacccagggttccccgttggcttcccttccatctaaaggcctcccccaagttaggaatcgatatagttctccccggtggtgaagtccacttcctcctcccttcccacttcccacagcaactggggggacaccccgaggcattcaccatgggcttttccacccgcctgcgagcgggaaccacctccgtagtttcctctcagagccgggcgtggagagggctgggcctgcgaagaggatgcatggcctggaggctggcgggcggcgggctggagtcgggagggcgaggcgacagcgccaagcggcgaggaagggcaaggggtttccccacaactgccttgggctctgggaggcgggatcccgcctggacggggtccctgagggaggagagcggcacacgacagccgcgatgccttccctgccgacggggatagccgacttctggcgagtcgacccctcccccaaatccaccccacccgcgtactccctcctgacctagctgtcgcgagcctgccgcgaggaggccagggtgagggtgggaacacatcctagaaggctaacacgtggttttctatcatttaagccggggacaagccggaaggctgactagcgccatcactctgataggcaccccgcagtggggatcctgcttgattattaaaggcagacctccaagttcctccctgctctgcaacctttctcttctcacgggtctgcagtgttttaaaagtcgtcattctgtgtcgttgagttagagaggaaaacatcggataaaagaggatcaagaagaacgaaccctagatacatctgtctggtgaaaggagtctaggaaaagaagtttcattcttagaacaaatctttttggatatttattatgtgtgttttgtgtcaggtttcgggccaaaaagctgaaataaagaacgaagtcaataataatatgaagtgtatgagaaatagctggaaaattcatcatccatgacttgaagaaattgacgttttacaagttatattttcggttcgtattgtggagtcacttaaggagctatcccaaagtactttaggatatgtaactatataaaaccttccaagaatgcagccctcataggatagttaaaataaggattttaatgggctattttgatttggtttggtctggtttggctacctgattcctgctgtctttttctacgccaggtgaagaggcactttcaagatccttctctgagacctgcaccaataagactataccaatgttcagttgaaacatcagacactgttctggttatgatggacaccacagtgaaagagacctggtccctgccttgaggaaacccaactgctggtagagagctcagagtaatgattaggatgcaatatgagggatgcagtaattgggatctacttctgggaaccgtcacagcctgagaaagatggcatgccctgaatggaattcacagagaattattttaagtaaaagaagtttaaagttaaa

SEQ ID NO: 287896 - DNA, 1583 bp, Homo sapiens
  misc_feature (2)..(3): n is a, c, g, or t
tnngtagcgctcccttttgggatcaacgagctgtgtggcgcctgtgcggcttctgagagaccggctggtggcgcttggcggcttcctgccaatccacccttctcctcccgcgcaagggggcaatcccaatcccaccaccgggaacacccaggccaaaagaacgggagttacactcaaagtcttcccccttcttatcactcctgccgatttccctcttcctttttgcacgcctccactcttccccaccggaaacgccgccccttcctcctacagttcctcccagcagtccctcaacgcctgtcttccctcgcgcgtagagagtgactcgaaggaccccctctcctcttcgctgcagcccctccccatgcacgctgggagactcttggaggggataaggtggggcccggagaggaagagaagacaatcggattggataggcagctgccatggcaactggaggctgtggttatattgtcatagtaaccgatgtgtgcggacagggtcaccctccccttggccaatggattcccaggaaaccacccagggttccccgttggcttcccttccatctaaaggcctcccccaagtttcgggccaaaaagctgaaataaagaacgaagtcaataataatatgaagtgtatgagaaatagctggaaaattcatcatccatgacttgaagaaattgacgttttacaagttatattttcggtgaagaggcactttcaagatccttctctgagacctgcaccaataagactataccaatgttcagttgaaacatcagacactgttctggttatgatggacaccacagtgaaagagacctggtccctgccttgaggaaacccaactgctggtagagagctcagagtaatgattaggatgcaatatgagggatgcagtaattgggatctacttctgggaaccgtcacagcctgagaaagatggcatgccctgaatggaattcacagagaattattttaagtcatgctactggccccgcccagttatgtaacaacttgcatttcctcaattctctggaatgtggccagtcaggaacttccacatttggttttttttttttcccccatttgtgggtaagaaagtaaaagaggcaggaaaactgaattgagaaagaagaaagaataggggaagagagaaagaaaaaagaaaaccatgaagcctggaagaggagaaagaagagatagatgagcaaagaagcacattgcctggtggtagtaatagttgtcagacacccatctattataatctgttttccatgggagattttaagaagaggctagatccccagtctgtcttaaaatcaagaaaagggactctgttgcctctaaagtatacttccagactcagcaatctctaaattctgagtggggcatccctagttttgctgcctaaaatctatgacagttggaaatgattccatttaagatccagttcaagaagctatacaccctgaggaactttatattgccatttagaggaccgatattctccagattgcttgagcccaggagtttgagaccagcctgggcaacatggcaaaactccatctctaccaaaa

SEQ ID NO: 287897 - DNA, 2135 bp, Homo sapiens
gccagcaggacgtggctcagtttgccgatttccgggaagtgctgactacaagggcaacccagctctcagaggaactggcccagctccgggatgcctatcagaagcagaaggagcagctgcggcaacaactagaagcccctccaagccagagggatgggcactttctccaggaaagccggcgactctctgcccagtttgaaaatctcatggcagagagccgccaggacctggaggaggagtatgagcctcagttcctgcggctcctagagaggaaagaagctgggaccaaagctctgcagagaacccaggctgagatccaggaaatgaaggaggctctgagacccctgcaagcagaggcccggcagctccgcctgcaaaacaggaacctggaggaccagatcgcacttgtgaggcaaaaacgagatgaagaggtgcagcagtacagggaacagctggaggaaatggaagaacgccagaggcagttaagaaatggggtgcaactccagcaacagaagaacaaagagatggaacagctaaggctcagtcttgctgaagagctctctacttataaggctatgctactacccaagagcctggaacaggctgatgctcccacttctcaggcaggtggaatggagacacagtctcaaggggctgtttagaaatatatggccaaatctgtaacccggaaacagcaaaaaacttcttagcaaaggatcactaagtaccctttggatgtactcttccaaccagacaagagtgccagaaacttggcaagcaattcatcctgtggaagttgcaaatactggctgacctgcttaaaaagattctagagttggccggaggcagaacatgtcaactctttgctggattctatttcatctgctgttgatactgatctcaatgcaccaaggaaaggaaagatgagcctcctgtcttccagcaacaaccctcacatatgcactgagtaaaggatgaatgtatggacacatctgggagtattttaaagaatgtatcttgccttgtgttgacccaaaccaaaaacatttttgaggggcacatgtggggtcaaaaagatagccaatttccattacatgggtttacaatttccattcttttgtgccacgagtgttagaatttaaatgaatacttttacaaagtctactttttgttcaaggatatgctgacccatatagtttactcttaaaattgtgtcaaggtatttctcactatactctaaaacaactagacttgaaaagaaaccatttgagatttgaatctaatggttaacgctattcagattttcccaaagatcttacctcatgaaagtagttctgggtcagaatgatctactcagttaaaaaacaacaacaacaaaaaactaagcgattgggaaaaaacaggaattttatctggttattgcatctggtgatagaggccttcaaagcctattatttctaacctaagtaaaggccccagtgaaaaacatactggggaaataaaacctctgagaaaaggttcaagcaccttttccaaatttaaatcttgccttaaattctctctaccacactgcctttgacactcttggaagtccatgtagttctctacagacagacttcaaagaaacgttaccttatcaaagactaatctgtgccacctctgattcagtgttttatgtctttcactttccctgggaaggagtaaagttcttttctacagctctgggactattacatttaattctgctcttgatagtcaaagaccatggacaacaactgtcatctgaaggactcttctagaagccagagactggtgtttgatggatgttttatactaaataaaacccatcagcatggggttatgtagaaaagcaatttattccattttaagcacttacacagttagtcatggagagtaacaggcctgctggtgaaacaggtcacccaaaatggagatggcatcaaactagtggtcaaggactaactcctaaaaaaaaaaagcaactcttatcaaggattaatttaatttttaaaacaaatacaagttattgattcactcttcccaacttgacagtctacctgtggtataactgtcaggtaaaaacatacatctttacaacttggtggtcccaagtt

SEQ ID NO: 287898 - DNA, 1894 bp, Homo sapiens
gaggattttcttatactgtgtttgaatccacatgactgataatatgcttaatgtttgagaaattataaccttgcaattgaggttaatgatctactaactacctttgtgttgatcagattgtgtacaatctggaaaagacaacgactaatccaaagaaatgaaactacagaatttcaggcattgtaattatacctgtaagaagttaacctagcagagaaaacgtttaactatccctcccatcaccatcaccattcattctatttgacaaacaggaggcatccaaatatttgctaggggaaagtcatccctgatcatccataaatcacactgtaacaatctcttctcaacaaagcctgcagtaactaaacctcagaagttcactgttataaactttttctttcaactttacagggctgtttagaaatatatggccaaatctgtaacccggaaacagcaaaaaacttcttagcaaaggatcactaagtaccctttggatgtactcttccaaccagacaagagtgccagaaacttggcaagcaattcatcctgtggaagttgcaaatactggctgacctgcttaaaaagattctagagttggccggaggcagaacatgtcaactctttgctggattctatttcatctgctgttgatactgatctcaatgcaccaaggaaaggaaagatgagcctcctgtcttccagcaacaaccctcacatatgcactgagtaaaggatgaatgtatggacacatctgggagtattttaaagaatgtatcttgccttgtgttgacccaaaccaaaaacatttttgaggggcacatgtggggtcaaaaagatagccaatttccattacatgggtttacaatttccattcttttgtgccacgagtgttagaatttaaatgaatacttttacaaagtctactttttgttcaaggatatgctgacccatatagtttactcttaaaattgtgtcaaggtatttctcactatactctaaaacaactagacttgaaaagaaaccatttgagatttgaatctaatggttaacgctattcagattttcccaaagatcttacctcatgaaagtagttctgggtcagaatgatctactcagttaaaaaacaacaacaacaaaaaactaagcgattgggaaaaaacaggaattttatctggttattgcatctggtgatagaggccttcaaagcctattatttctaacctaagtaaaggccccagtgaaaaacatactggggaaataaaacctctgagaaaaggttcaagcaccttttccaaatttaaatcttgccttaaattctctctaccacactgcctttgacactcttggaagtccatgtagttctctacagacagacttcaaagaaacgttaccttatcaaagactaatctgtgccacctctgattcagtgttttatgtctttcactttccctgggaaggagtaaagttcttttctacagctctgggactattacatttaattctgctcttgatagtcaaagaccatggacaacaactgtcatctgaaggactcttctagaagccagagactggtgtttgatggatgttttatactaaataaaacccatcagcatggggttatgtagaaaagcaatttattccattttaagcacttacacagttagtcatggagagtaacaggcctgctggtgaaacaggtcacccaaaatggagatggcatcaaactagtggtcaaggactaactcctaaaaaaaaaaagcaactcttatcaaggattaatttaatttttaaaacaaatacaagttattgattcactcttcccaacttgacagtctacctgtggtataactgtcaggtaaaaacatacatctttacaacttggtggtcccaagtt

SEQ ID NO: 287899 - DNA, 2055 bp, Homo sapiens
gccagcaggacgtggctcagtttgccgatttccgggaagtgctgactacaagggcaacccagctctcagaggaactggcccagctccgggatgcctatcagaagcagaaggagcagctgcggcaacaactagaagcccctccaagccagagggatgggcactttctccaggaaagccggcgactctctgcccagtttgaaaatctcatggcagagagccgccaggacctggaggaggagtatgagcctcagttcctgcggctcctagagaggaaagaagctgggaccaaagctctgcagagaacccaggctgagatccaggaaatgaaggaggctctgagacccctgcaagcagaggcccggcagctccgcctgcaaaacaggaacctggaggaccagatcgcacttgtgaggcaaaaacgagatgaagaggtgcagcagtacagggaacagctggaggaaatggaagaacgccagaggcagttaagaaatggggtgcaactccagcaacagaagaacaaagagatggaacagctaaggctcagtcttgctgaagagctctctacttataagggctgtttagaaatatatggccaaatctgtaacccggaaacagcaaaaaacttcttagcaaaggatcactaagtaccctttggatgtactcttccaaccagacaagagtgccagaaacttggcaagcaattcatcctgtggaagttgcaaatactggctgacctgcttaaaaagattctagagttggccggaggcagaacatgtcaactctttgctggattctatttcatctgctgttgatactgatctcaatgcaccaaggaaaggaaagatgagcctcctgtcttccagcaacaaccctcacatatgcactgagtaaaggatgaatgtatggacacatctgggagtattttaaagaatgtatcttgccttgtgttgacccaaaccaaaaacatttttgaggggcacatgtggggtcaaaaagatagccaatttccattacatgggtttacaatttccattcttttgtgccacgagtgttagaatttaaatgaatacttttacaaagtctactttttgttcaaggatatgctgacccatatagtttactcttaaaattgtgtcaaggtatttctcactatactctaaaacaactagacttgaaaagaaaccatttgagatttgaatctaatggttaacgctattcagattttcccaaagatcttacctcatgaaagtagttctgggtcagaatgatctactcagttaaaaaacaacaacaacaaaaaactaagcgattgggaaaaaacaggaattttatctggttattgcatctggtgatagaggccttcaaagcctattatttctaacctaagtaaaggccccagtgaaaaacatactggggaaataaaacctctgagaaaaggttcaagcaccttttccaaatttaaatcttgccttaaattctctctaccacactgcctttgacactcttggaagtccatgtagttctctacagacagacttcaaagaaacgttaccttatcaaagactaatctgtgccacctctgattcagtgttttatgtctttcactttccctgggaaggagtaaagttcttttctacagctctgggactattacatttaattctgctcttgatagtcaaagaccatggacaacaactgtcatctgaaggactcttctagaagccagagactggtgtttgatggatgttttatactaaataaaacccatcagcatggggttatgtagaaaagcaatttattccattttaagcacttacacagttagtcatggagagtaacaggcctgctggtgaaacaggtcacccaaaatggagatggcatcaaactagtggtcaaggactaactcctaaaaaaaaaaagcaactcttatcaaggattaatttaatttttaaaacaaatacaagttattgattcactcttcccaacttgacagtctacctgtggtataactgtcaggtaaaaacatacatctttacaacttggtggtcccaagtt

SEQ ID NO: 287900 - DNA, 1154 bp, Homo sapiens
atgttaagtaccaggtagaaatctctctgactttaaggagctttggacacaaaaacttttccttaaacaagccatttattttctaaacatggacttccactagttgtgtaactctcctagaattctagccaatatttaataattgttgccacacttttgtatttcaacttaagtattttatattattaaaaactaccaattatcttaacaaacctgcacatggagggagaggtatatgaaactcagcccactaactagaccaaaatcctcctcaatgacactaaggttgtaatactaaaaagtcccaatcaccctcccaggattctattaaagcaagctgtggttaacagacaagatgcctttttcgtcatcattttcaaaagcattgtcactttttttccaagacacaacttctttgaacctgtttcataacctatcatataaataccagcctcaatactgctatcaagattaaacaatgaacaaaaaagtgttttataagtaagagtggacaatgtgagtttttattgtttggctcattagaaatgttcttggccatctcatgcaggaacagctggaggaaatggaagaacgccagaggcagttaagaaatggggtgcaactccagcaacagaagaacaaagagatggaacagctaaggctcagtcttgctgaagagctctctacttataagtcagtttctgctgctatacaaatctcatctaatactggctgaggggatggtgggagggcttagggaaaattttaccttagaatcaaaaacaaaaagaggatttgggaaatgattttcaaattgtgcttatccaaaaacacatggaaaatggctctctctttttaaagggctatgctactacccaagagcctggaacaggctgatgctcccacttctcaggcaggtggaatggagacacagtctcaaggtgatctttgtgaagagaagagtggtgtttgcattgttactgctttcctaacaatactaattaatgccttaaaaacaggccggacggggtggctcacgcctgtaatcccagcactttgggaggctgaggagggtggatcacctggagtcaggagttcaagaccagcctggccaacatggcaaaactccatctccactaaaaatacaaaaatta

SEQ ID NO: 287901 - DNA, 2425 bp, Homo sapiens
atgttaagtaccaggtagaaatctctctgactttaaggagctttggacacaaaaacttttccttaaacaagccatttattttctaaacatggacttccactagttgtgtaactctcctagaattctagccaatatttaataattgttgccacacttttgtatttcaacttaagtattttatattattaaaaactaccaattatcttaacaaacctgcacatggagggagaggtatatgaaactcagcccactaactagaccaaaatcctcctcaatgacactaaggttgtaatactaaaaagtcccaatcaccctcccaggattctattaaagcaagctgtggttaacagacaagatgcctttttcgtcatcattttcaaaagcattgtcactttttttccaagacacaacttctttgaacctgtttcataacctatcatataaataccagcctcaatactgctatcaagattaaacaatgaacaaaaaagtgttttataagtaagagtggacaatgtgagtttttattgtttggctcattagaaatgttcttggccatctcatgcaggaacagctggaggaaatggaagaacgccagaggcagttaagaaatggggtgcaactccagcaacagaagaacaaagagatggaacagctaaggctcagtcttgctgaagagctctctacttataagtcagtttctgctgctatacaaatctcatctaatactggctgaggggatggtgggagggcttagggaaaattttaccttagaatcaaaaacaaaaagaggatttgggaaatgattttcaaattgtgcttatccaaaaacacatggaaaatggctctctctttttaaagggctatgctactacccaagagcctggaacaggctgatgctcccacttctcaggcaggtggaatggagacacagtctcaaggggctgtttagaaatatatggccaaatctgtaacccggaaacagcaaaaaacttcttagcaaaggatcactaagtaccctttggatgtactcttccaaccagacaagagtgccagaaacttggcaagcaattcatcctgtggaagttgcaaatactggctgacctgcttaaaaagattctagagttggccggaggcagaacatgtcaactctttgctggattctatttcatctgctgttgatactgatctcaatgcaccaaggaaaggaaagatgagcctcctgtcttccagcaacaaccctcacatatgcactgagtaaaggatgaatgtatggacacatctgggagtattttaaagaatgtatcttgccttgtgttgacccaaaccaaaaacatttttgaggggcacatgtggggtcaaaaagatagccaatttccattacatgggtttacaatttccattcttttgtgccacgagtgttagaatttaaatgaatacttttacaaagtctactttttgttcaaggatatgctgacccatatagtttactcttaaaattgtgtcaaggtatttctcactatactctaaaacaactagacttgaaaagaaaccatttgagatttgaatctaatggttaacgctattcagattttcccaaagatcttacctcatgaaagtagttctgggtcagaatgatctactcagttaaaaaacaacaacaacaaaaaactaagcgattgggaaaaaacaggaattttatctggttattgcatctggtgatagaggccttcaaagcctattatttctaacctaagtaaaggccccagtgaaaaacatactggggaaataaaacctctgagaaaaggttcaagcaccttttccaaatttaaatcttgccttaaattctctctaccacactgcctttgacactcttggaagtccatgtagttctctacagacagacttcaaagaaacgttaccttatcaaagactaatctgtgccacctctgattcagtgttttatgtctttcactttccctgggaaggagtaaagttcttttctacagctctgggactattacatttaattctgctcttgatagtcaaagaccatggacaacaactgtcatctgaaggactcttctagaagccagagactggtgtttgatggatgttttatactaaataaaacccatcagcatggggttatgtagaaaagcaatttattccattttaagcacttacacagttagtcatggagagtaacaggcctgctggtgaaacaggtcacccaaaatggagatggcatcaaactagtggtcaaggactaactcctaaaaaaaaaaagcaactcttatcaaggattaatttaatttttaaaacaaatacaagttattgattcactcttcccaacttgacagtctacctgtggtataactgtcaggtaaaaacatacatctttacaacttggtggtcccaagtt

SEQ ID NO: 287902 - DNA, 840 bp, Homo sapiens
  misc_feature (41)..(41): n is a, c, g, or t
  misc_feature (45)..(45): n is a, c, g, or t
cagtgtacgctcgatacggatcgaggcgtctgtcgggctgnagcnggggaggagcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtggtaatgtatgtacagaagaaaaagcgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatggcggcggctggtagacacctttgctttctctagccctcctgggctgggcttgggcacaaatccccaggcaggctttggagttgtttccatggtgatggggccagatgtatagtattcagtatatattttgtaaataaaatgttttgtggcta

SEQ ID NO: 287903 - DNA, 870 bp, Homo sapiens
ctttgatcacgcgcctgacggcttttccggggcccgggagccaaccgagggcgttcctgtcggggctgcagcggcgggagggagcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtggtaatgtatgtacagaagaaaaagcgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatggcggcggctggtagacacctttgctttctctagccctcctgggctgggcttgggcacaaatccccaggcaggctttggagttgtttccatggtgatggggccagatgtatagtattcagtatatattttgtaaataaaatgttttgtggcta

SEQ ID NO: 287904 - DNA, 1122 bp, Homo sapiens
ctttgatcacgcgcctgacggcttttccggggcccgggagccaaccgagggcgttcctgtcggggctgcagcggcgggaggtaaggcatggccaggccggctgggctgcagagcgccggcacgggtccacgcctcgggtgacgggcttccaggatgttcgggcgcggggcggcccatccgcatcccccaacacccccacctccggcctgagcctcccagcgccgtgggaaccacctcctgtccgctgttgctggcccgcatcctagcagcggcctgacgccctccccaccctggcatgcccccttgacctgggacgatgagcatacgactggggagcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtggtaatgtatgtacagaagaaaaagcgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatggcggcggctggtagacacctttgctttctctagccctcctgggctgggcttgggcacaaatccccaggcaggctttggagttgtttccatggtgatggggccagatgtatagtattcagtatatattttgtaaataaaatgttttgtggcta

SEQ ID NO: 287905 - DNA, 1215 bp, Homo sapiens
ctttgatcacgcgcctgacggcttttccggggcccgggagccaaccgagggcgttcctgtcggggctgcagcggcgggagggagcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtggtaatgtatgtacagaagaaaaagcgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatggcggcggctggtagacacctttgctttctctagccctcctgggctgggcttgggcacaaatccccaggcaggctttggagttgtttccatggtgatggggccagatgtatagtattcagtatatattttgtaaataaaatgttttgtggctaaaaaaaaaaaaaaactcaaaaaaaaacactaaatataaacgcacgaaccacacttcactccagagcgacgccgatcccaattccaccgctcttggcggtacaacaacaaaaactctggggggggggcccttccccatattcccctttatgaaggccgttccacaacaatcggccggtgtcaacacaccccggaccggagaaacaccgggtgtcccacaagttaactgccctgaacgaataacgcctttcgccaagggggataatccaaaaaggcccccccatatccttttcaaaaaattgcctcgcttgataacaggctctttttaccacaggcgccatttgaat

SEQ ID NO: 287906 - DNA, 810 bp, Homo sapiens
ctttgatcacgcgcctgacggcttttccggggcccgggagccaaccgagggcgttcctgtcggggctgcagcggcgggagggagcccagtggaggcgccctcccgaagcgccactgcccatgctgaccacccagccctccggctgctgatgtcatgagtaacaccactgtgcccaatgccccccaggccaacagcgactccatggtaatgtatgtacagaagaaaaagcgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatggcggcggctggtagacacctttgctttctctagccctcctgggctgggcttgggcacaaatccccaggcaggctttggagttgtttccatggtgatggggccagatgtatagtattcagtatatattttgtaaataaaatgttttgtggcta

SEQ ID NO: 287907 - DNA, 1348 bp, Homo sapiens
  misc_feature (41)..(41): n is a, c, g, or t
  misc_feature (45)..(45): n is a, c, g, or t
cagtgtacgctcgatacggatcgaggcgtctgtcgggctgnagcnggggaggagcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtggtaaggagccctcatatacacacagacacccacagctttgctaaggcaggggctgggtgggcctggtccagtctgcacagagtccccactgtcctgttaagggagtgaagggtgtggaggtgggcctctctctgcctgtgggccttcctgggctcagcagcccccacagtgctgtgtctctgttgcaggtaatgtatgtacagaagaaaaagcggtgagtgtccctgtcccccacccgccctaaccccatcacccgttctgaaattcctgctcataggctctgacttttctgtaagatgtccctcagccatcctgatacaagcctgaaatttgttttccctgccccagcctcaggttactcactggggaaagcccctttgtagaatcagggttgtattcttggaggtatagtgtgtcccaaaaggcacccactggaattgcccctgcctgggaaagggaggagagacgaggcagccaggtgtttgatgagggttggggggacctcctagctgagtcccctcccctgctccccagggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatggcggcggctggtagacacctttgctttctctagccctcctgggctgggcttgggcacaaatccccaggcaggctttggagttgtttccatggtgatggggccagatgtatagtattcagtatatattttgtaaataaaatgttttgtggcta

SEQ ID NO: 287908 - DNA, 844 bp, Homo sapiens
ctttgatcacgcgcctgacggcttttccggggcccgggagccaaccgagggcgttcctgtcggggctgcagcggcgggagggagcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatggcggcggctggtagacacctttgctttctctagccctcctgggctgggcttgggcacaaatccccaggcaggctttggagttgtttccatggtgatggggccagatgtatagtattcagtatatattttgtaaataaaatgttttgtggcta

SEQ ID NO: 287909 - DNA, 1072 bp, Homo sapiens
ctttgatcacgcgcctgacggcttttccggggcccgggagccaaccgagggcgttcctgtcggggctgcagcggcgggagggagcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtggtaatgtatgtacagaagaaaaagcgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatggcggcggctggtagacacctttgctttctctagccctcctgggctgggcttgggcacaaatccccaggcaggctttggagttgtttccatggtgatggggccagatgtatagtattcagtatatattttgtaaataaaatgttttgtggctagcctacacacaacagaccgacagaaaacacagagacaacacgacacagaaacacgagcccccgcccgccacgagcgagagcggaagaaccgaccacacacacacccacgccacggccccggccgacgcaacgagccgaacgaccaccgcaaggcagacccacacgaacaacgagccgacgagcgcccggcccgccacacaca

SEQ ID NO: 287910 - DNA, 1523 bp, Homo sapiens
  misc_feature (41)..(41): n is a, c, g, or t
  misc_feature (45)..(45): n is a, c, g, or t
cagtgtacgctcgatacggatcgaggcgtctgtcgggctgnagcnggggaggagcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtggtaaggagccctcatatacacacagacacccacagctttgctaaggcaggggctgggtgggcctggtccagtctgcacagagtccccactgtcctgttaagggagtgaagggtgtggaggtgggcctctctctgcctgtgggccttcctgggctcagcagcccccacagtgctgtgtctctgttgcaggtaatgtatgtacagaagaaaaagcggtgagtgtccctgtcccccacccgccctaaccccatcacccgttctgaaattcctgctcataggctctgacttttctgtaagatgtccctcagccatcctgatacaagcctgaaatttgttttccctgccccagcctcaggttactcactggggaaagcccctttgtagaatcagggttgtattcttggaggtatagtgtgtcccaaaaggcacccactggaattgcccctgcctgggaaagggaggagagacgaggcagccaggtgtttgatgagggttggggggacctcctagctgagtcccctcccctgctccccagggtggaccggctgcgccatcacctgctccccatgtacagctatgacccagctgaggaactgcatgaggctgagcaggagctgctctctgacatgggagaccccaaggtgagcacttgggggccagggggagaatgaggcaaggtgggagtcagccctgttcccagccatactcgtccacactgaaaccagagcctggttctgcttacttgggctgtaactgggtgctgcagactcccagggaacacagcccagccttgtggtgtggtctcctccccgacaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatggcggcggctggtagacacctttgctttctctagccctcctgggctgggcttgggcacaaatccccaggcaggctttggagttgtttccatggtgatggggccagatgtatagtattcagtatatattttgtaaataaaatgttttgtggcta

SEQ ID NO: 287911 - DNA, 1617 bp, Homo sapiens
ctttgatcacgcgcctgacggcttttccggggcccgggagccaaccgagggcgttcctgtcggggctgcagcggcgggaggtaaggcatggccaggccggctgggctgcagagcgccggcacgggtccacgcctcgggtgacgggcttccaggatgttcgggcgcggggcggcccatccgcatcccccaacacccccacctccggcctgagcctcccagcgccgtgggaaccacctcctgtccgctgttgctggcccgcatcctagcagcggcctgacgccctccccaccctggcatgcccccttgacctgggacgatgagcatacgactggggagcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtggtaatgtatgtacagaagaaaaagcggtgagtgtccctgtcccccacccgccctaaccccatcacccgttctgaaattcctgctcataggctctgacttttctgtaagatgtccctcagccatcctgatacaagcctgaaatttgttttccctgccccagcctcaggttactcactggggaaagcccctttgtagaatcagggttgtattcttggaggtatagtgtgtcccaaaaggcacccactggaattgcccctgcctgggaaagggaggagagacgaggcagccaggtgtttgatgagggttggggggacctcctagctgagtcccctcccctgctccccagggtggaccggctgcgccatcacctgctccccatgtacagctatgacccagctgaggaactgcatgaggctgagcaggagctgctctctgacatgggagaccccaaggtgagcacttgggggccagggggagaatgaggcaaggtgggagtcagccctgttcccagccatactcgtccacactgaaaccagagcctggttctgcttacttgggctgtaactgggtgctgcagactcccagggaacacagcccagccttgtggtgtggtctcctccccgacaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccctccacccaccctcagcagcatctgcttcccatgccctcaccatcacctcactgcccccaggccttctgccctttgtgggtgttgagctcaccgcccacccacaggcactcatgggaagaggctttccttctgggatggcggcggctggtagacacctttgctttctctagccctcctgggctgggcttgggcacaaatccccaggcaggctttggagttgtttccatggtgatggggccagatgtatagtattcagtatatattttgtaaataaaatgttttgtggcta

SEQ ID NO: 287912 - DNA, 1021 bp, Homo sapiens
ctttgatcacgcgcctgacggcttttccggggcccgggagccaaccgagggcgttcctgtcggggctgcagcggcgggaggtaaggcatggccaggccggctgggctgcagagcgccggcacgggtccacgcctcgggtgacgggcttccaggatgttcgggcgcggggcggcccatccgcatcccccaacacccccacctccggcctgagcctcccagcgccgtgggaaccacctcctgtccgctgttgctggcccgcatcctagcagcggcctgacgccctccccaccctggcatgcccccttgacctgggacgatgagcatacgactggggagcccagtggaggcgccctcccgaagcgccactgcccatgctgaccacccagccctccggctgctgatgtcatgagtaacaccactgtgcccaatgccccccaggccaacagcgactccatggtgggctatgtgttggggcccttcttcctcatcaccctggtcggggtggtggtggctgtggtaatgtatgtacagaagaaaaagcgggtggaccggctgcgccatcacctgctccccatgtacagctatgacccagctgaggaactgcatgaggctgagcaggagctgctctctgacatgggagaccccaaggtggtacatggctggcagagtggctaccagcacaagcggatgccactgctggatgtcaagacgtgacctgacccccttgccccacccttcagagcctggggtcctggactgcctggggccctgccatctgcttcccctgctgtcacctggctccccctgctgggtgctgggtctccatttctccacaggcactcatgggaagaggctttccttctgggatggcggcggctggtagacacctttgctttctctagccctcctgggctgggcttgggcacaaatccccaggcaggctttggagttgtttccatggtgatggggccagatgtatagtattcagtatatattttgtaaataaaatgttttgtggcta

SEQ ID NO: 287913 - DNA, 680 bp, Homo sapiens
cgggagccaaccgagggcgttcctgtcggggctgcagcggcgggaggtaaggcatggccaggccggctgggctgcagagcgccggcacgggtccacgcctcgggtgacgggcttccaggatgttcgggcgcggggcggcccatccgcatcccccaacacccccacctccggcctgagcctcccagcgccgtgggaaccacctcctgtccgctgttgctggcccgcatcctagcagcggcctgacgccctccccaccctggcatgcccccttgacctgggacgatgagcatacgactgggtaagggcaagctcgatgccccgtgccctacggacacgggggtaggtcgctcataccttgccctctgatagagactcaagcgaacctgggtcgcggaccttgggccatcagcgtgcaaactgccccaggacgatctctttgcttctgtcgatggggactgaccctctccacctctgcctgtcagctcaggccaggaggggagggacctgggcggagccccgggtggagacaagaggaaggtgacatcatcttgaagatacaatccagctttacccactcgtgtccaccctggcacacgagacagatgggggagagggtgtttgggctgtatgtctgaggtgacaccagggacaagggcatagaactcaggcatggagcccat

SEQ ID NO: 287914 - DNA, 486 bp, Homo sapiens
cggccgccctggggtcggggcaattgccgcgttgccctgccctccgggatccctgggggcctctgctcctctctttgtggagacgtcgtttcaccggcggcgcgtgaccccggcagctgtccagagacccagagatgtccaatcacaggcgcacggtgcacaggcgcgcagggctgcctggaacgggcccaggcaggcagtgaccgggacctctccggaggggagaggacggtgccctcccgggcaggagctggccaggcaggcgctgcccagggcggcctccctgctggactacggcattgccactgagttatataaagacactatttggggaaggacagcgggtgaggactggcgcggcggcacacgccttgcctgttgtctcagctcttctgggggccaaggccaggagtccagggttacagtgagccgtgatggccagtgcgttccaaaagagagaaacagagagaaagggaatcaggctta

SEQ ID NO: 287915 - DNA, 1614 bp, Homo sapiens
acgtcgagtccggggcggcgcctggaggcggagccgcccgctgcggtaaatggggcagaggccgggaggggtgggggttccccgcgccgcagccatggagcagcttcgcgccgccgcccgtctgcagattgttctgggccacctcggccgcccctcggccggggctgtcgtagctcatcccacttcagggactatttcctctgccagtttccatcctcaacaattccagtatactctggataataatgttctaaccctggaacagagaaaattttatgaagaaaatgggtttctagtaatcaaaaatcttgtacctgatgccgatattcaacgctttcggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaaggcaatttcctgccatttcgccagtgccgattgccactacattgacgtgaagggcaccagtcaagaaaacatcgagaaggaagttgtaggaatagcacataaattctttggagctgaaaatagcgtgaacttgaaggatatttggatgtttcgagctcgacttgtgaaaggagaaagaaccaatctttgaaatagccatctgctataactctttcaacagaaaaccaaaaccaaacgaaatgtctaaggaaaatgttttcttaatgagatgatgtaaccttttctatcacttgttaaaagcagaaaacatgtatcaggtacttaattgcatagagttagttttgcagcacaatggtgttgctttaatggaaaaaaaaacagtaaaagtgaaatattactgttttaaggaaaactaatttagggtggcagccaataaaggtggttggtgtctaatttaagtgttaaatcaatttctttcattcagttagctctttacccaagaagaagtgaatgatttggagcttagggtatgttttgtatcccctttctgataaacccattccctaccaattttatgtcataagagatttttttcccccaaatctagaacaatgtataatacattcacatctagtcaagggcataggaacggtgtcatggagtccaaataaagtggatattcctgctcggaca

SEQ ID NO: 287916 - DNA, 1108 bp, Homo sapiens
gtccggagctgctgagggatcccgggtccttctgttggtctgagaccctggggcgggcggaatcccggagaaagccggagggactccccagtggaagcctgggagctgccgttctcctccctgcctgtgcaaacaggaaggggctggtgatgctggctgcgggcctccctcctggactgcgacattgtcaccaaattctataaagacgtcatgcaggaagtgataacgtgtgctgcgacgttctggaagtaactcgaagctaaaaaagaacaaaaaatcaatgaaaaaatgaaactaaagaaacaatgagatgctatgtcaatatccgtagttatggaatggaaaataaatcttacaaagagatgctggagttatctaagaaatttacaccatactggcctgtgtgcatcagacttttctggaggtcatttattttattcactttttttttttttatgaccaaccgaactttctaatattttgggctggagtcccactaaatgaaataccccttttgaatggcacatatgacttttagggatgcatcttagcatttttatttttttatttttattttcaaaacttcattgatgttttggagttttgtttgttttttgtttttgtgttttttggacatggcctcactctgtcgcccaggctggagtgcagaggcacgatctgggctcactgcaacttcaaactcccgggctcaggtgatcctcctgcagcaggacgagccgcagacaaaactcagacaccggattaaagaagggctgtattaggccgggaacttcggcagacttgcaaccgaggtccctgaaaaagaaattcttggcccttttaagggcttgtaactctaagggtctacgtgaaagtagctcatcccacttcagggactatttcctctgccagtttccatcctcaacaattccagtatactctggataataatgttctaaccctggaacagagaaaattttatgaagaaaatgggtttctagtaatcaaaaatcttgtacctgatgccgatattcaacgctttcggtacagtaacactatttgttattttacaatagtatgtattgtgtgcatgtaatgagaatacaag

SEQ ID NO: 287917 - DNA, 1709 bp, Homo sapiens
attaggaggggggttgttaggggttcggaggaaaagttcggggaacagctaaataggttgttgttgatttggttaaaaaatagtagagggatgatgctaataattaggctgtgggtggttgtgttgattccgcaatgagtacagattataatctgtactcattgggtgggggttccccgcgccgcagccatggagcagcttcgcgccgccgcccgtctgcagattgttctgggccacctcggccgcccctcggccggggctgtcgtagctcatcccacttcagggactatttcctctgccagtttccatcctcaacaattccagtatactctggataataatgttctaaccctggaacagagaaaattttatgaagaaaatgggtttctagtaatcaaaaatcttgtacctgatgccgatattcaacgctttcggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaaggcaatttcctgccatttcgccagtgccgattgccactacattgacgtgaagggcaccagtcaagaaaacatcgagaaggaagttgtaggaatagcacataaattctttggagctgaaaatagcgtgaacttgaaggatatttggatgtttcgagctcgacttgtgaaaggagaaagaaccaatctttgaaatagccatctgctataactctttcaacagaaaaccaaaaccaaacgaaatgtctaaggaaaatgttttcttaatgagatgatgtaaccttttctatcacttgttaaaagcagaaaacatgtatcaggtacttaattgcatagagttagttttgcagcacaatggtgttgctttaatggaaaaaaaaacagtaaaagtgaaatattactgttttaaggaaaactaatttagggtggcagccaataaaggtggttggtgtctaatttaagtgttaaatcaatttctttcattcagttagctctttacccaagaagaagtgaatgatttggagcttagggtatgttttgtatcccctttctgataaacccattccctaccaattttatgtcataagagatttttttcccccaaatctagaacaatgtataatacattcacatctagtcaagggcataggaacggtgtcatggagtccaaataaagtggatattcctgctcggaca

SEQ ID NO: 287918 - DNA, 1730 bp, Homo sapiens
cggccgccctggggtcggggcaattgccgcgttgccctgccctccgggatccctgggggcctctgctcctctctttgtggagacgtcgtttcaccggcggcgcgtgaccccggcagctgtccagagacccagagatgtccaatcacaggcgcacggtgcacaggcgcgcagggctgcctggaacgggcccaggcaggcagtgaccgggacctctccggaggggagaggacggtgccctcccgggcaggagctggccaggcaggcgctgcccagggcggcctccctgctggactacggcattgccactgagttatataaagacactatttggggaaggacagcgggtatactctggataataatgttctaaccctggaacagagaaaattttatgaagaaaatgggtttctagtaatcaaaaatcttgtacctgatgccgatattcaacgctttcggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaaggcaatttcctgccatttcgccagtgccgattgccactacattgacgtgaagggcaccagtcaagaaaacatcgagaaggaagttgtaggaatagcacataaattctttggagctgaaaatagcgtgaacttgaaggatatttggatgtttcgagctcgacttgtgaaaggagaaagaaccaatctttgaaatagccatctgctataactctttcaacagaaaaccaaaaccaaacgaaatgtctaaggaaaatgttttcttaatgagatgatgtaaccttttctatcacttgttaaaagcagaaaacatgtatcaggtacttaattgcatagagttagttttgcagcacaatggtgttgctttaatggaaaaaaaaacagtaaaagtgaaatattactgttttaaggaaaactaatttagggtggcagccaataaaggtggttggtgtctaatttaagtgttaaatcaatttctttcattcagttagctctttacccaagaagaagtgaatgatttggagcttagggtatgttttgtatcccctttctgataaacccattccctaccaattttatgtcataagagatttttttcccccaaatctagaacaatgtataatacattcacatctagtcaagggcataggaacggtgtcatggagtccaaataaagtggatattcctgctcggaca

SEQ ID NO: 287919 - DNA, 1789 bp, Homo sapiens
cggccgccctggggtcggggcaattgccgcgttgccctgccctccgggatccctgggggcctctgctcctctctttgtggagacgtcgtttcaccggcggcgcgtgaccccggcagctgtccagagacccagagatgtccaatcacaggcgcacggtgcacaggcgcgcagggctgcctggaacgggcccaggcaggcagtgaccgggacctctccggaggggagaggacggtgccctcccgggcaggagctggccaggcaggcgctgcccagggcggcctccctgctggactacggcattgccactgagttatataaagacactatttggggaaggacagcgggtagctcatcccacttcagggactatttcctctgccagtttccatcctcaacaattccagtatactctggataataatgttctaaccctggaacagagaaaattttatgaagaaaatgggtttctagtaatcaaaaatcttgtacctgatgccgatattcaacgctttcggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaaggcaatttcctgccatttcgccagtgccgattgccactacattgacgtgaagggcaccagtcaagaaaacatcgagaaggaagttgtaggaatagcacataaattctttggagctgaaaatagcgtgaacttgaaggatatttggatgtttcgagctcgacttgtgaaaggagaaagaaccaatctttgaaatagccatctgctataactctttcaacagaaaaccaaaaccaaacgaaatgtctaaggaaaatgttttcttaatgagatgatgtaaccttttctatcacttgttaaaagcagaaaacatgtatcaggtacttaattgcatagagttagttttgcagcacaatggtgttgctttaatggaaaaaaaaacagtaaaagtgaaatattactgttttaaggaaaactaatttagggtggcagccaataaaggtggttggtgtctaatttaagtgttaaatcaatttctttcattcagttagctctttacccaagaagaagtgaatgatttggagcttagggtatgttttgtatcccctttctgataaacccattccctaccaattttatgtcataagagatttttttcccccaaatctagaacaatgtataatacattcacatctagtcaagggcataggaacggtgtcatggagtccaaataaagtggatattcctgctcggaca

SEQ ID NO: 287920 - DNA, 2319 bp, Homo sapiens
gtccggagctgctgagggatcccgggtccttctgttggtctgagaccctggggcgggcggaatcccggagaaagccggagggactccccagtggaagcctgggagctgccgttctcctccctgcctgtgcaaacaggaaggggctggtgatgctggctgcgggcctccctcctggactgcgacattgtcaccaaattctataaagacgtcatgcaggaagtgataacgtgtgctgcgacgttctggaagtaactcgaagctaaaaaagaacaaaaaatcaatgaaaaaatgaaactaaagaaacaatgagatgctatgtcaatatccgtagttatggaatggaaaataaatcttacaaagagatgctggagttatctaagaaatttacaccatactggcctgtgtgcatcagacttttctggaggtcatttattttattcactttttttttttttatgaccaaccgaactttctaatattttgggctggagtcccactaaatgaaataccccttttgaatggcacatatgacttttagggatgcatcttagcatttttatttttttatttttattttcaaaacttcattgatgttttggagttttgtttgttttttgtttttgtgttttttggacatggcctcactctgtcgcccaggctggagtgcagaggcacgatctgggctcactgcaacttcaaactcccgggctcaggtgatcctcctgcagcaggacgagccgcagacaaaactcagacaccggattaaagaagggctgtattaggccgggaacttcggcagacttgcaaccgaggtccctgaaaaagaaattcttggcccttttaagggcttgtaactctaagggtctacgtgaaagtagctcatcccacttcagggactatttcctctgccagtttccatcctcaacaattccagtatactctggataataatgttctaaccctggaacagagaaaattttatgaagaaaatgggtttctagtaatcaaaaatcttgtacctgatgccgatattcaacgctttcggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaaggcaatttcctgccatttcgccagtgccgattgccactacattgacgtgaagggcaccagtcaagaaaacatcgagaaggaagttgtaggaatagcacataaattctttggagctgaaaatagcgtgaacttgaaggatatttggatgtttcgagctcgacttgtgaaaggagaaagaaccaatctttgaaatagccatctgctataactctttcaacagaaaaccaaaaccaaacgaaatgtctaaggaaaatgttttcttaatgagatgatgtaaccttttctatcacttgttaaaagcagaaaacatgtatcaggtacttaattgcatagagttagttttgcagcacaatggtgttgctttaatggaaaaaaaaacagtaaaagtgaaatattactgttttaaggaaaactaatttagggtggcagccaataaaggtggttggtgtctaatttaagtgttaaatcaatttctttcattcagttagctctttacccaagaagaagtgaatgatttggagcttagggtatgttttgtatcccctttctgataaacccattccctaccaattttatgtcataagagatttttttcccccaaatctagaacaatgtataatacattcacatctagtcaagggcataggaacggtgtcatggagtccaaataaagtggatattcctgctcggaca

SEQ ID NO: 287921 - DNA, 1656 bp, Homo sapiens
attaggaggggggttgttaggggttcggaggaaaagttcggggaacagctaaataggttgttgttgatttggttaaaaaatagtagagggatgatgctaataattaggctgtgggtggttgtgttgattccgcaatgagtacagattataatctgtactcattgggtgggggttccccgcgccgcagccatggagcagcttcgcgccgccgcccgtctgcagattgttctgggccacctcggccgcccctcggccggggctgtcgtagctcatcccacttcagggactatttcctctgccagtttccatcctcaacaattccagtatactctggataataatgttctaaccctggaacagagaaaattttatgaagaaaatgggtttctagtaatcaaaaatcttgtacctgatgccgatattcaacgctttcgtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaaggcaatttcctgccatttcgccagtgccgattgccactacattgacgtgaagggcaccagtcaagaaaacatcgagaaggaagttgtaggaatagcacataaattctttggagctgaaaatagcgtgaacttgaaggatatttggatgtttcgagctcgacttgtgaaaggagaaagaaccaatctttgaaatagccatctgctataactctttcaacagaaaaccaaaaccaaacgaaatgtctaaggaaaatgttttcttaatgagatgatgtaaccttttctatcacttgttaaaagcagaaaacatgtatcaggtacttaattgcatagagttagttttgcagcacaatggtgttgctttaatggaaaaaaaaacagtaaaagtgaaatattactgttttaaggaaaactaatttagggtggcagccaataaaggtggttggtgtctaatttaagtgttaaatcaatttctttcattcagttagctctttacccaagaagaagtgaatgatttggagcttagggtatgttttgtatcccctttctgataaacccattccctaccaattttatgtcataagagatttttttcccccaaatctagaacaatgtataatacattcacatctagtcaagggcataggaacggtgtcatggagtccaaataaagtggatattcctgctcggaca

SEQ ID NO: 287922 - DNA, 2032 bp, Homo sapiens
gccagactggctttttattttttatagagaaaggttctcactctgttgtgtaggctgagtgcagtggtgcgatcatagcttactgcggcctcaagttcctgggctcaagcaatcctcttgcctcagcctcctgagtagctgggaccacagttgtgcaccaccatacccagctaattttttatttctttgtttttagagacagggagtctcactatgttgcccaggctggtcttgaactcctggcctcaccctcctgagttgctgggattacagtcgggagccaccatgcctgggcttcagtctcagctccaccacttaatatcatgtgtcctggggcaatttacttcacatcccatgcctctgtttcctcatctgtaaaatggggataataatagcacttatgtcctagtgttgttattaggactaaatacggtgaaatatatggaaaccactttgaagagagctgggcacatggtaagtgttacagaaatgtttgctgttattattattacaatgtaaccaaattataaaaagacttccctactggtatgctaaactagggaataatttaattctgggaatggattctagccagacagtttctcctccctttcattggaattattctacctcaagctggaggccaacttagtgcagagaaaccacccctcaagtctgcaaccctttccacagaggagggcagggcaggtgcttggagccagcggtaacgacatcatttgcaaattaaattttctaggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaaggcaatttcctgccatttcgccagtgccgattgccactacattgacgtgaagggcaccagtcaagaaaacatcgagaaggaagttgtaggaatagcacataaattctttggagctgaaaatagcgtgaacttgaaggatatttggatgtttcgagctcgacttgtgaaaggagaaagaaccaatctttgaaatagccatctgctataactctttcaacagaaaaccaaaaccaaacgaaatgtctaaggaaaatgttttcttaatgagatgatgtaaccttttctatcacttgttaaaagcagaaaacatgtatcaggtacttaattgcatagagttagttttgcagcacaatggtgttgctttaatggaaaaaaaaacagtaaaagtgaaatattactgttttaaggaaaactaatttagggtggcagccaataaaggtggttggtgtctaatttaagtgttaaatcaatttctttcattcagttagctctttacccaagaagaagtgaatgatttggagcttagggtatgttttgtatcccctttctgataaacccattccctaccaattttatgtcataagagatttttttcccccaaatctagaacaatgtataatacattcacatctagtcaagggcataggaacggtgtcatggagtccaaataaagtggatattcctgctcggaca

SEQ ID NO: 287923 - DNA, 1558 bp, Homo sapiens
acgtcgagtccggggcggcgcctggaggcggagccgcccgctgcggtaaatggggcagaggccgggaggggtgggggttccccgcgccgcagccatggagcagcttcgcgccgccgcccgtctgcagattgttctgggccacctcggccgcccctcggccggggctgtcgtagctcatcccacttcagggactatttcctctgccagtttccatcctcaacaattccagtatactctggataataatgttctaaccctggaacagagaaaattttatgaagaaaatgggtttctagtaatcaaaaatcttgtacctgatgccgatattcaacgctttcggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaaggcaatttcctgccatttcgccagtgccgattgccactacattgacgtgaagggcaccagtcaagaaaacatcgagaaggaagttgtaggaatagcacataaattctttggagctgaaaatagcgtgaacttgaaggatatttggatgtttcgagctcgacttgtgaaaggagaaagaaccaatctttgaaatagccatctgctataactctttcaacagaaaaccaaaaccaaacgaaatgtctaaggaaaatgttttcttaatgagatgatgtaaccttttctatcacttgttaaaagcagaaaacatgtatcaggtacttaattgcatagagttagttttgcagcacaatggtgttgctttaatggaaaaaaaaacagtaaaagtgaaatattactgttttaaggaatcaatttctttcattcagttagctctttacccaagaagaagtgaatgatttggagcttagggtatgttttgtatcccctttctgataaacccattccctaccaattttatgtcataagagatttttttcccccaaatctagaacaatgtataatacattcacatctagtcaagggcataggaacggtgtcatggagtccaaataaagtggatattcctgctcggaca

SEQ ID NO: 287924 - DNA, 1070 bp, Homo sapiens
cggccgccctggggtcggggcaattgccgcgttgccctgccctccgggatccctgggggcctctgctcctctctttgtggagacgtcgtttcaccggcggcgcgtgaccccggcagctgtccagagacccagagatgtccaatcacaggcgcacggtgcacaggcgcgcagggctgcctggaacgggcccaggcaggcagtgaccgggacctctccggaggggagaggacggtgccctcccgggcaggagctggccaggcaggcgctgcccagggcggcctccctgctggactacggcattgccactgagttatataaagacactatttggggaaggacagcgggtatactctggataataatgttctaaccctggaacagagaaaattttatgaagaaaatgggtttctagtaatcaaaaatcttgtacctgatgccgatattcaacgctttcggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggtaattgtaagggagaagaaaaaaaaatggtttcattaaaatgtgtaaggttggctgggtgcagtaactcatgcctgtaatcccagcattttaggagaccaagggaggaagatctctgaggccaggagtttgagagtggcctgggcaacatagtgaggctctgtctctaaaaataaaatttaaaaatatccaggcatggtggtatgcacctgtagtccctgctattggaaggctgaggtgggaggatcacttgagcccaggagttgaaggctgcagtgaacctataatggcatgctctccagcctgcgtgacacagtgagaccctatctctacataataaataaaacaaaacaaaacaaaataa

SEQ ID NO: 287925 - DNA, 494 bp, Homo sapiens
acgtcgagtccggggcggcgcctggaggcggagccgcccgctgcggtaaatggggcagaggccgggaggggtgggggttccccgcgccgcagccatggagcagcttcgcgccgccgcccgtctgcagattgttctgggccacctcggccgcccctcggccggggctgtcgtagctcatcccacttcagggactatttcctctgccagtttccatcctcaacaattccatactctggctaataaagctctacccttggaacagacaacattctatcccgactctgctccccctagacctcactcctctctcacccctctccctctctttcacctgctctcctaactcctcccactattctctgtctctcccccttcctcccccctccctcttacctgctccctgttccctcccttcctcccccccactacgccccttacccctcccttcttccgctctaccacccccctctccttccctccctctctctctctct

SEQ ID NO: 287926 - DNA, 1459 bp, Homo sapiens
  misc_feature (1075)..(1075): n is a, c, g, or t
  misc_feature (1135)..(1135): n is a, c, g, or t
  misc_feature (1449)..(1449): n is a, c, g, or t
ctgatggcttcgctgtcttctgtaaaaattgctatgagagaacttttcactcactgttttgcagtttctccctcagtccctggttctttcttctcacataatcccaatttcaatttatagttcatggcccaggcagagtcattcatcacggcatctcctgagctaaaccagcacctgctctgctcacttcttgactggctgctcatcatcagccctctgcagagatttcatttcctccgtgccagtagccatcgaccctctgatgaggatgccccctccaacaggcaccgccaggcagccctgcctggagacccagaggcaccgagtcacatttgctctgcacacctggctctcgcttgatgtgggcctgtgtgctacagcccggaacacaaaagaagacacccatgcaaataccattaaaagtttattgttttatttcaatattcaggaacagtgtacactttccgttcagccatcgtcacagcacgtgctgtgtgggtgcggccacgtatggatcgcagagccgacctcagctcagcgacgcagagtgcttctgctgaaaaatttggaggtttgtgtctggagttttgttctttgtaactctctcatcatcgaggctatatattaatagacatggtattaagcccacacgaaacattcagaattagaattggattaagaagacgcgttttggcatcacgctgactactcctcatctccgtcctcggggagggtgatgccagcgtgggactctttggaaggcctatcaatcacaggtgcgctaaaatcaaaaggtgggtcagtaggttagggagggaggcgcgaaaggagatgccagcgggtgttaagaaggatatggtcagaagagctctttgtctccatccacggggccgtctgctcagcccgtgtgtctcggtgagtaattcgggagcaggtgcacgcctgtgcctactcgctaccacgcgtcttctgggaggaagtgaatgagccggttatcttctcagggagggttagtgctggccactgtgcactgccgctgccagcacgcccggtcacagccagtgtctatgggcgnctggcgcggctgcgaggctgtctagaggactcctacccttctgctctgagtgcgcaagtnttcctggactctccggctgtgggctgtggtttggaaacgaggttgttcatagaggctgctctggggccaccatgcagggcaacggtgacgtccagaggccacctgcttgacatctccatcaccaaatctccaggaagaccctgtttcctatgtgaggccattgcccagcccacgtttgcctccttttcctccctctgccacacgcgaattcagctaattggggtgtgtgggcagccacggcctggggaggtggcccctctctgtgctgcccacgttggactctacagctgcccagccgcatgtacataccaaanctccacatgt

SEQ ID NO: 287927 - DNA, 1293 bp, Homo sapiens
tttttgtacataatatacattatttctgttgatgtacctcttaatgacatctcggtcaatgatggactgtatatatgatggtggtcccataggattataatggagctgaaaaattcctgttacctagcgacattgtaatgtggcacaatacattagtcatgagtttgtggtgatggctggtgtaaacaaacctgcattgccagtcatataaaagtctagcacatacaattatgtacagtgcataatacttgatagtgataataaaagatattactgatttatgtatttactatacaatatacttttattattttacagtgtactcctatttatttaaaaagttaactataaaacagcctcaggcaggtccttcaggagatattccagaagagggcattgttatcatagatgacagctccattcatgttactgaccctgaagaccttcaagtgggacaagatatggaggtggaagacagtggtattgatgatcctgaccacgggtaggcttaggtttatgtgtgtgtatgtgtcttagtttttaacaaaaaaattaaaaagtaaaaaaactaaaaatagaaaaatgcttagagaataaggatataaagaatatttttgtgcagttgaacaatgagtgcttaagctaaatgtcatcacaaaagagtaaaaaaattttacaaaattaaaaatgtttaaagttaaaaagctctaggaagctaaggtcaatttattattggagaaataaaattatttttatgaatttactgtagcctaggtgtacattatttatcatgtctacagtagtgttcagcaattaggccttcacattctctcaccactcactcactcagtcactcacccagagcagcttccagtcccgcaagctccatttatggtaagtgccctgtacaggtgtaccatttttttaatccattataccatatttttattgtaccttttctatgtttagatttgtttagatacacaagtaccactgtgttacagttgcctatagtactcagtacagtaacacactttacaagcttatagcctaggaacaataggctataccatctaggtttgtgtaagtacactcttatgatgttcacacagtgacaaaatcgcccaaggatgcattcatcagaacacattcccattgttatccaatgcatgactgtataatggttttatggattaaattttttatgtaattcaactggaaagtatttttatgttattttggaaaaaataaaacaatgacaattgaaatcatggaatctgcaaagattcacag

SEQ ID NO: 287928 - DNA, 779 bp, Homo sapiens
agacagtttcttccgcttcctgtaccacccggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggatcaaggtattgcagatccaggggaataagtctgagagcttcctatcttccggagagtgtgactaattcaatcctgaggccattaaaggaatcaagtccttggat

SEQ ID NO: 287929 - DNA, 635 bp, Homo sapiens
agacagtttcttccgcttcctgtaccacccggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaatgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgaggtgattagtttcatcatac

SEQ ID NO: 287930 - DNA, 4603 bp, Homo sapiens
agacagtttcttccgcttcctgtaccacccggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatggtttgtatttgaacatggtgattcctccttcacttcaccttaacggaatgtctttatttgaattttatttgtaaaatgtgtcctgtttaaatttttcaatctttaaaaataatttttatgtactttttttttttttttaacctttcttgcactctgggtcatgggtaccactgcaatggcttcccctttttttatgggataccaactgcaatatggtcctcaatgctgttctggccatttcaatgactaatgccaaacatctgtatgactaatttttttatgttaaaaaaatactgtttaatgctggctctatggtgatttggttttactaaattgggtttctcgttgggggtggtcttttgaatactgggttttatatattctgctatttttaacgtgtggtttttttcgatatctgggttctaaaagaaatctttggaattaagagaaaaacaagctgaaaaggaagaaaagcagaaaacaaagaaaatagaaacaagtgcagaaaagttgcgtaagctcttaaaagaagagaagaggtaaactataatattcagtatttttaaacttaaggcaactactgaattgaacccaaagtgccatactggaggtaaagtaaataaaaatatgaaagtatttcaagtgccaatcagtgactgttaagaatctttagcaaatatgtgttccatgtattttcttattaaagagatgaagtggaatttaaggctagaattctacaaaaaaagagtatcttagaattaaaatatagaataagttactttaattatgttttaggaagaaatattttagaactagagcagtggttctcaactaggggtggatttattcacccggggacatttgacaagatgtggagacatttttgattgccataactgatagggtgctactgcatctagtgtataatggtcagggatgctcttaaacattctgtaatgcacaggtcagctcccacccgcacccccaccccctaccaagaattatttggctgaaaataccaataatcaggtgaagaaaccatgaactagaggtagccaaataaaaaagttgagttctcctttatgtgttcagtagtcttaagtttttaaggtagtgttgaaaaaagtctgtctttcagagatgatggatttgcttacaatgatacctgtctgcaagcattttttcccccaaaagtgcttaatagtaaaattagatcttgtagtagccgagattattgtatcatttatctgaaccacagcttttataaaatctttaaaggaaacaaatagggcccacatctttatgaataatttagaaacatttttgtatatatatgacaaatgaactgttttttttaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttgaaagatta

SEQ ID NO: 287931 - DNA, 4760 bp, Homo sapiens
agacagtttcttccgcttcctgtaccacccggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatggtttgtatttgaacatggtgattcctccttcacttcaccttaacggaatgtctttatttgaattttatttgtaaaatgtgtcctgtttaaatttttcaatctttaaaaataatttttatgtactttttttttttttttaacctttcttgcactctgggtcatgggtaccactgcaatggcttcccctttttttatgggataccaactgcaatatggtcctcaatgctgttctggccatttcaatgactaatgccaaacatctgtatgactaatttttttatgttaaaaaaatactgtttaatgctggctctatggtgatttggttttactaaattgggtttctcgttgggggtggtcttttgaatactgggttttatatattctgctatttttaacgtgtggtttttttcgatatctgggttctaaaagaaatctttggaattaagagaaaaacaagctgaaaaggaagaaaagcagaaaacaaagaaaatagaaacaagtgcagaaaagttgcgtaagctcttaaaagaagagaagaggtaaactataatattcagtatttttaaacttaaggcaactactgaattgaacccaaagtgccatactggaggtaaagtaaataaaaatatgaaagtatttcaagtgccaatcagtgactgttaagaatctttagcaaatatgtgttccatgtattttcttattaaagagatgaagtggaatttaaggctagaattctacaaaaaaagagtatcttagaattaaaatatagaataagttactttaattatgttttaggaagaaatattttagaactagagcagtggttctcaactaggggtggatttattcacccggggacatttgacaagatgtggagacatttttgattgccataactgatagggtgctactgcatctagtgtataatggtcagggatgctcttaaacattctgtaatgcacaggtcagctcccacccgcacccccaccccctaccaagaattatttggctgaaaataccaataatcaggtgaagaaaccatgaactagaggtagccaaataaaaaagttgagttctcctttatgtgttcagtagtcttaagtttttaaggtagtgttgaaaaaagtctgtctttcagagatgatggatttgcttacaatgatacctgtctgcaagcattttttcccccaaaagtgcttaatagtaaaattagatcttgtagtagccgagattattgtatcatttatctgaaccacagcttttataaaatctttaaaggaaacaaatagggcccacatctttatgaataatttagaaacatttttgtatatatatgacaaatgaactgttttttttaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttgaaagattaaaaaaaaaaatgtttcttgaacacttttatatttatcagtttaaatattacattttttgcccaattttttttaaaatttttaaatggtagattatatgtcttaattttcctctaaagcccaatttgattaaaagtggtttgtgaacagtcattggct

SEQ ID NO: 287932 - DNA, 4511 bp, Homo sapiens
gctgggtggacggggggcgctcctgggttgtgcaatgcgggatgcgggctgaactttttctctggcactgcttggtagaggcgcagattccttagctaaaaatcccttgagctttcctatctgagttggaggcgtcactttttaagtttccccgctctccacctccagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatggtttgtatttgaacatggtgattcctccttcacttcaccttaacggaatgtctttatttgaattttatttgtaaaatgtgtcctgtttaaatttttcaatctttaaaaataatttttatgtactttttttttttttttaacctttcttgcactctgggtcatgggtaccactgcaatggcttcccctttttttatgggataccaactgcaatatggtcctcaatgctgttctggccatttcaatgactaatgccaaacatctgtatgactaatttttttatgttaaaaaaatactgtttaatgctggctctatggtgatttggttttactaaattgggtttctcgttgggggtggtcttttgaatactgggttttatatattctgctatttttaacgtgtggtttttttcgatatctgggttctaaaagaaatctttggaattaagagaaaaacaagctgaaaaggaagaaaagcagaaaacaaagaaaatagaaacaagtgcagaaaagttgcgtaagctcttaaaagaagagaagaggtaaactataatattcagtatttttaaacttaaggcaactactgaattgaacccaaagtgccatactggaggtaaagtaaataaaaatatgaaagtatttcaagtgccaatcagtgactgttaagaatctttagcaaatatgtgttccatgtattttcttattaaagagatgaagtggaatttaaggctagaattctacaaaaaaagagtatcttagaattaaaatatagaataagttactttaattatgttttaggaagaaatattttagaactagagcagtggttctcaactaggggtggatttattcacccggggacatttgacaagatgtggagacatttttgattgccataactgatagggtgctactgcatctagtgtataatggtcagggatgctcttaaacattctgtaatgcacaggtcagctcccacccgcacccccaccccctaccaagaattatttggctgaaaataccaataatcaggtgaagaaaccatgaactagaggtagccaaataaaaaagttgagttctcctttatgtgttcagtagtcttaagtttttaaggtagtgttgaaaaaagtctgtctttcagagatgatggatttgcttacaatgatacctgtctgcaagcattttttcccccaaaagtgcttaatagtaaaattagatcttgtagtagccgagattattgtatcatttatctgaaccacagcttttataaaatctttaaaggaaacaaatagggcccacatctttatgaataatttagaaacatttttgtatatatatgacaaatgaactgttttttttaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttgaaagatta

SEQ ID NO: 287933 - DNA, 4549 bp, Homo sapiens
agacagtttcttccgcttcctgtaccacccggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaatgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatggtttgtatttgaacatggtgattcctccttcacttcaccttaacggaatgtctttatttgaattttatttgtaaaatgtgtcctgtttaaatttttcaatctttaaaaataatttttatgtactttttttttttttttaacctttcttgcactctgggtcatgggtaccactgcaatggcttcccctttttttatgggataccaactgcaatatggtcctcaatgctgttctggccatttcaatgactaatgccaaacatctgtatgactaatttttttatgttaaaaaaatactgtttaatgctggctctatggtgatttggttttactaaattgggtttctcgttgggggtggtcttttgaatactgggttttatatattctgctatttttaacgtgtggtttttttcgatatctgggttctaaaagaaatctttggaattaagagaaaaacaagctgaaaaggaagaaaagcagaaaacaaagaaaatagaaacaagtgcagaaaagttgcgtaagctcttaaaagaagagaagaggtaaactataatattcagtatttttaaacttaaggcaactactgaattgaacccaaagtgccatactggaggtaaagtaaataaaaatatgaaagtatttcaagtgccaatcagtgactgttaagaatctttagcaaatatgtgttccatgtattttcttattaaagagatgaagtggaatttaaggctagaattctacaaaaaaagagtatcttagaattaaaatatagaataagttactttaattatgttttaggaagaaatattttagaactagagcagtggttctcaactaggggtggatttattcacccggggacatttgacaagatgtggagacatttttgattgccataactgatagggtgctactgcatctagtgtataatggtcagggatgctcttaaacattctgtaatgcacaggtcagctcccacccgcacccccaccccctaccaagaattatttggctgaaaataccaataatcaggtgaagaaaccatgaactagaggtagccaaataaaaaagttgagttctcctttatgtgttcagtagtcttaagtttttaaggtagtgttgaaaaaagtctgtctttcagagatgatggatttgcttacaatgatacctgtctgcaagcattttttcccccaaaagtgcttaatagtaaaattagatcttgtagtagccgagattattgtatcatttatctgaaccacagcttttataaaatctttaaaggaaacaaatagggcccacatctttatgaataatttagaaacatttttgtatatatatgacaaatgaactgttttttttaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttgaaagatta

SEQ ID NO: 287934 - DNA, 3860 bp, Homo sapiens
tagagtttcatagaaatgcgaacgggtatgctgtcgaattcataagaacagggaggtgagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatggtttgtatttgaacatggtgattcctccttcacttcaccttaacggaatgtctttatttgaattttatttgtaaaatgtgtcctgtttaaatttttcaatctttaaaaataatttttatgtactttttttttttttttaacctttcttgcactctgggtcatgggtaccactgcaatggcttcccctttttttatgggataccaactgcaatatggtcctcaatgctgttctggccatttcaatgactaatgccaaacatctgtatgactaatttttttatgttaaaaaaatactgtttaatgctggctctatggtgatttggttttactaaattgggtttctcgttgggggtggtcttttgaatactgggttttatatattctgctatttttaacgtgtggtttttttcgatatctgggttctaaaagaaatctttggaattaagagaaaaacaagctgaaaaggaagaaaagcagaaaacaaagaaaatagaaacaagtgcagaaaagttgcgtaagctcttaaaagaagagaagaggtaaactataatattcagtatttttaaacttaaggcaactactgaattgaacccaaagtgccatactggaggtaaagtaaataaaaatatgaaagtatttcaagtgccaatcagtgactgttaagaatctttagcaaatatgtgttccatgtattttcttattaaagagatgaagtggaatttaaggctagaattctacaaaaaaagagtatcttagaattaaaatatagaataagttactttaattatgttttaggaagaaatattttagaactagagcagtggttctcaactaggggtggatttattcacccggggacatttgacaagatgtggagacatttttgattgccataactgatagggtgctactgcatctagtgtataatggtcagggatgctcttaaacattctgtaatgcacaggtcagctcccacccgcacccccaccccctaccaagaattatttggctgaaaataccaataatcaggtgaagaaaccatgaactagaggtagccaaataaaaaagttgagttctcctttatgtgttcagtagtcttaagtttttaaggtagtgttgaaaaaagtctgtctttcagagatgatggatttgcttacaatgatacctgtctgcaagcattttttcccccaaaagtgcttaatagtaaaattagatcttgtagtagccgagattattgtatcatttatctgaaccacagcttttataaaatctttaaaggaaacaaatagggcccacatctttatgaataatttagaaacatttttgtatatatatgacaaatgaactgttttttttaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttgaaagatta

SEQ ID NO: 287935 - DNA, 3931 bp, Homo sapiens
atgggtatggagacatatcatataagtaatgctagggtgagtggtaggaagttttttcataggaggtgtatgagttggtcgtagcggaatcgggggtatgctgttcgaattcagaagtacagggaggtgagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatggtttgtatttgaacatggtgattcctccttcacttcaccttaacggaatgtctttatttgaattttatttgtaaaatgtgtcctgtttaaatttttcaatctttaaaaataatttttatgtactttttttttttttttaacctttcttgcactctgggtcatgggtaccactgcaatggcttcccctttttttatgggataccaactgcaatatggtcctcaatgctgttctggccatttcaatgactaatgccaaacatctgtatgactaatttttttatgttaaaaaaatactgtttaatgctggctctatggtgatttggttttactaaattgggtttctcgttgggggtggtcttttgaatactgggttttatatattctgctatttttaacgtgtggtttttttcgatatctgggttctaaaagaaatctttggaattaagagaaaaacaagctgaaaaggaagaaaagcagaaaacaaagaaaatagaaacaagtgcagaaaagttgcgtaagctcttaaaagaagagaagaggtaaactataatattcagtatttttaaacttaaggcaactactgaattgaacccaaagtgccatactggaggtaaagtaaataaaaatatgaaagtatttcaagtgccaatcagtgactgttaagaatctttagcaaatatgtgttccatgtattttcttattaaagagatgaagtggaatttaaggctagaattctacaaaaaaagagtatcttagaattaaaatatagaataagttactttaattatgttttaggaagaaatattttagaactagagcagtggttctcaactaggggtggatttattcacccggggacatttgacaagatgtggagacatttttgattgccataactgatagggtgctactgcatctagtgtataatggtcagggatgctcttaaacattctgtaatgcacaggtcagctcccacccgcacccccaccccctaccaagaattatttggctgaaaataccaataatcaggtgaagaaaccatgaactagaggtagccaaataaaaaagttgagttctcctttatgtgttcagtagtcttaagtttttaaggtagtgttgaaaaaagtctgtctttcagagatgatggatttgcttacaatgatacctgtctgcaagcattttttcccccaaaagtgcttaatagtaaaattagatcttgtagtagccgagattattgtatcatttatctgaaccacagcttttataaaatctttaaaggaaacaaatagggcccacatctttatgaataatttagaaacatttttgtatatatatgacaaatgaactgttttttttaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttgaaagatta

SEQ ID NO: 287936 - DNA, 3784 bp, Homo sapiens
agacagtttcttccgcttcctgtaccacccggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatggtttgtatttgaacatggtgattcctccttcacttcaccttaacggaatgtctttatttgaattttatttgtaaaatgtgtcctgtttaaatttttcaatctttaaaaataatttttatgtactttttttttttttttaacctttcttgcactctgggtcatgggtaccactgcaatggcttcccctttttttatgggataccaactgcaatatggtcctcaatgctgttctggccatttcaatgactaatgccaaacatctgtatgactaatttttttatgttaaaaaaatactgtttaatgctggctctatggtgatttggttttactaaattgggtttctcgttgggggtggtcttttgaatactgggttttatatattctgctatttttaacgtgtggtttttttcgatatctgggttctaaaagaaatctttggaattaagagaaaaacaagctgaaaaggaagaaaagcagaaaacaaagaaaatagaaacaagtgcagaaaagttgcgtaagctcttaaaagaagagaagaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttgaaagatta

SEQ ID NO: 287937 - DNA, 4174 bp, Homo sapiens
agacagtttcttccgcttcctgtaccacccggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatgaaatctttggaattaagagaaaaacaagctgaaaaggaagaaaagcagaaaacaaagaaaatagaaacaagtgcagaaaagttgcgtaagctcttaaaagaagagaagaggtaaactataatattcagtatttttaaacttaaggcaactactgaattgaacccaaagtgccatactggaggtaaagtaaataaaaatatgaaagtatttcaagtgccaatcagtgactgttaagaatctttagcaaatatgtgttccatgtattttcttattaaagagatgaagtggaatttaaggctagaattctacaaaaaaagagtatcttagaattaaaatatagaataagttactttaattatgttttaggaagaaatattttagaactagagcagtggttctcaactaggggtggatttattcacccggggacatttgacaagatgtggagacatttttgattgccataactgatagggtgctactgcatctagtgtataatggtcagggatgctcttaaacattctgtaatgcacaggtcagctcccacccgcacccccaccccctaccaagaattatttggctgaaaataccaataatcaggtgaagaaaccatgaactagaggtagccaaataaaaaagttgagttctcctttatgtgttcagtagtcttaagtttttaaggtagtgttgaaaaaagtctgtctttcagagatgatggatttgcttacaatgatacctgtctgcaagcattttttcccccaaaagtgcttaatagtaaaattagatcttgtagtagccgagattattgtatcatttatctgaaccacagcttttataaaatctttaaaggaaacaaatagggcccacatctttatgaataatttagaaacatttttgtatatatatgacaaatgaactgttttttttaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttgaaagatta

SEQ ID NO: 287938 - DNA, 3668 bp, Homo sapiens
agacagtttcttccgcttcctgtaccacccggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcagaaatctttggaattaagagaaaaacaagctgaaaaggaagaaaagcagaaaacaaagaaaatagaaacaagtgcagaaaagttgcgtaagctcttaaaagaagagaagaggtaaactataatattcagtatttttaaacttaaggcaactactgaattgaacccaaagtgccatactggaggtaaagtaaataaaaatatgaaagtatttcaagtgccaatcagtgactgttaagaatctttagcaaatatgtgttccatgtattttcttattaaagagatgaagtggaatttaaggctagaattctacaaaaaaagagtatcttagaattaaaatatagaataagttactttaattatgttttaggaagaaatattttagaactagagcagtggttctcaactaggggtggatttattcacccggggacatttgacaagatgtggagacatttttgattgccataactgatagggtgctactgcatctagtgtataatggtcagggatgctcttaaacattctgtaatgcacaggtcagctcccacccgcacccccaccccctaccaagaattatttggctgaaaataccaataatcaggtgaagaaaccatgaactagaggtagccaaataaaaaagttgagttctcctttatgtgttcagtagtcttaagtttttaaggtagtgttgaaaaaagtctgtctttcagagatgatggatttgcttacaatgatacctgtctgcaagcattttttcccccaaaagtgcttaatagtaaaattagatcttgtagtagccgagattattgtatcatttatctgaaccacagcttttataaaatctttaaaggaaacaaatagggcccacatctttatgaataatttagaaacatttttgtatatatatgacaaatgaactgttttttttaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttgaaagatta

SEQ ID NO: 287939 - DNA, 3355 bp, Homo sapiens
agacagtttcttccgcttcctgtaccacccggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatgaaatctttggaattaagagaaaaacaagctgaaaaggaagaaaagcagaaaacaaagaaaatagaaacaagtgcagaaaagttgcgtaagctcttaaaagaagagaagaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttgaaagatta

SEQ ID NO: 287940 - DNA, 4135 bp, Homo sapiens
agacagtttcttccgcttcctgtaccacccggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatggtttgtatttgaacatggtgattcctccttcacttcaccttaacggaatgtctttatttgaattttatttgtaaaatgtgtcctgtttaaatttttcaatctttaaaaataatttttatgtactttttttttttttttaacctttcttgcactctgggtcatgggtaccactgcaatggcttcccctttttttatgggataccaactgcaatatggtcctcaatgctgttctggccatttcaatgactaatgccaaacatctgtatgactaatttttttatgttaaaaaaatactgtttaatgctggctctatggtgatttggttttactaaattgggtttctcgttgggggtggtcttttgaatactgggttttatatattctgctatttttaacgtgtggtttttttcgatatctgggttctaaaagaaatctttggaattaagagaaaaacaagctgaaaaggaagaaaagcagaaaacaaagaaaatagaaacaagtgcagaaaagttgcgtaagctcttaaaagaagagaagaggtaaactataatattcagtatttttaaacttaaggcaactactgaattgaacccaaagtgccatactggaggtaaagtaaataaaaatatgaaagtatttcaagtgccaatcagtgactgttaagaatctttagcaaatatgtgttccatgtattttcttattaaagagatgaagtggaatttaaggctagaattctacaaaaaaagagtatcttagaattaaaatatagaataagttactttaattatgttttaggaagaaatattttagaactagagcagtggttctcaactaggggtggatttattcacccggggacatttgacaagatgtggagacatttttgattgccataactgatagggtgctactgcatctagtgtataatggtcagggatgctcttaaacattctgtaatgcacaggtcagctcccacccgcacccccaccccctaccaagaattatttggctgaaaataccaataatcaggtgaagaaaccatgaactagaggtagccaaataaaaaagttgagttctcctttatgtgttcagtagtcttaagtttttaaggtagtgttgaaaaaagtctgtctttcagagatgatggatttgcttacaatgatacctgtctgcaagcattttttcccccaaaagtgcttaatagtaaaattagatcttgtagtagccgagattattgtatcatttatctgaaccacagcttttataaaatctttaaaggaaacaaatagggcccacatctttatgaataatttagaaacatttttgtatatatatgacaaatgaactgttttttttaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttga

SEQ ID NO: 287941 - DNA, 4602 bp, Homo sapiens
agacagtttcttccgcttcctgtaccacccggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatggtttgtatttgaacatggtgattcctccttcacttcaccttaacggaatgtctttatttgaattttatttgtaaaatgtgtcctgtttaaatttttcaatctttaaaaataatttttatgtactttttttttttttttaacctttcttgcactctgggtcatgggtaccactgcaatggcttcccctttttttatgggataccaactgcaatatggtcctcaatgctgttctggccatttcaatgactaatgccaaacatctgtatgactaatttttttatgttaaaaaaatactgtttaatgctggctctatggtgatttggttttactaaattgggtttctcgttgggggtggtcttttgaatactgggttttatatattctgctatttttaacgtgtggtttttttcgatatctgggttctaaaagaaatctttggaattaagagaaaaacaagctgaaaaggaagaaaagcagaaaacaaagaaaatagaaacaagtgcagaaaagttgcgtaagctcttaaaagaagagaagaggtaaactataatattcagtatttttaaacttaaggcaactactgaattgaacccaaagtgccatactggaggtaaagtaaataaaaatatgaaagtatttcaagtgccaatcagtgactgttaagaatctttagcaaatatgtgttccatgtattttcttattaaagagatgaagtggaatttaaggctagaattctacaaaaaaagagtatcttagaattaaaatatagaataagttactttaattatgttttaggaagaaatattttagaactagagcagtggttctcaactaggggtggatttattcacccggggacatttgacaagatgtggagacatttttgattgccataactgatagggtgctactgcatctagtgtataatggtcagggatgctcttaaacattctgtaatgcacaggtcagctcccacccgcacccccaccccctaccaagaattatttggctgaaaataccaataatcaggtgaagaaaccatgaactagaggtagccaaataaaaaagttgagttctcctttatgtgttcagtagtcttaagtttttaaggtagtgttgaaaaaagtctgtctttcagagatgatggatttgcttacaatgatacctgtctgcaagcattttttcccccaaaagtgcttaatagtaaaattagatcttgtagtagccgagattattgtatcatttatctgaaccacagcttttataaaatctttaaaggaaacaaatagggcccacatctttatgaataatttagaaacatttttgtatatatatgacaaatgaactgttttttttaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggagtgtactcctatttatttaaaaagttaactataaaacagcctcaggcaggtccttcaggagatattccagaagagggcattgttatcatagatgacagctccattcatgttactgaccctgaagaccttcaagtgggacaagatatggaggtggaagacagtggtattgatgatcctgaccacgggtaggcttaggtttatgtgtgtgtatgtgtcttagtttttaacaaaaaaattaaaaagtaaaaaaactaaaaatagaaaaatgcttagagaataaggatataaagaatatttttgtgcagttgaacaatgagtgcttaagctaaatgtcatcacaaaagagtaaaaaaattttacaaaattaaaaatgtttaaagttaaaaagctctaggaagctaaggtcaatttattattggagaaataaaattatttttatgaatttactgtagcctaggtgtacattatttatcatgtctacagtagtgttcagcaattaggccttcacattctctcaccactcactcactcagtcactcacccagagcagcttccagtcccgcaagctccatttatggtaagtgccctgtacaggtgtaccatttttttaatccattataccatatttttattgtaccttttctatgtttagatttgtttagatacacaagtaccactgtgttacagttgcctatagtactcagtacagtaacacactttacaagcttatagcctaggaacaataggctataccatctaggtttgtgtaagtacactcttatgatgttcacacagtgacaaaatcgcccaaggatgcattcatcagaacacattcccattgttatccaatgcatgactgtataatggttttatggattaaattttttatgtaattcaactggaaagtatttttatgttattttggaaaaaataaaacaatgacaattgaaatcatggaatctgcaaagattcacag

SEQ ID NO: 287942 - DNA, 2849 bp, Homo sapiens
agacagtttcttccgcttcctgtaccacccggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcagaaatctttggaattaagagaaaaacaagctgaaaaggaagaaaagcagaaaacaaagaaaatagaaacaagtgcagaaaagttgcgtaagctcttaaaagaagagaagaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttgaaagatta

SEQ ID NO: 287943 - DNA, 4058 bp, Homo sapiens
agacagtttcttccgcttcctgtaccacccggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatggtttgtatttgaacatggtgattcctccttcacttcaccttaacggaatgtctttatttgaattttatttgtaaaatgtgtcctgtttaaatttttcaatctttaaaaataatttttatgtactttttttttttttttaacctttcttgcactctgggtcatgggtaccactgcaatggcttcccctttttttatgggataccaactgcaatatggtcctcaatgctgttctggccatttcaatgactaatgccaaacatctgtatgactaatttttttatgttaaaaaaatactgtttaatgctggctctatggtgatttggttttactaaattgggtttctcgttgggggtggtcttttgaatactgggttttatatattctgctatttttaacgtgtggtttttttcgatatctgggttctaaaagaaatctttggaattaagagaaaaacaagctgaaaaggaagaaaagcagaaaacaaagaaaatagaaacaagtgcagaaaagttgcgtaagctcttaaaagaagagaagaggtaaactataatattcagtatttttaaacttaaggcaactactgaattgaacccaaagtgccatactggaggtaaagtaaataaaaatatgaaagtatttcaagtgccaatcagtgactgttaagaatctttagcaaatatgtgttccatgtattttcttattaaagagatgaagtggaatttaaggctagaattctacaaaaaaagagtatcttagaattaaaatatagaataagttactttaattatgttttaggaagaaatattttagaactagagcagtggttctcaactaggggtggatttattcacccggggacatttgacaagatgtggagacatttttgattgccataactgatagggtgctactgcatctagtgtataatggtcagggatgctcttaaacattctgtaatgcacaggtcagctcccacccgcacccccaccccctaccaagaattatttggctgaaaataccaataatcaggtgaagaaaccatgaactagaggtagccaaataaaaaagttgagttctcctttatgtgttcagtagtcttaagtttttaaggtagtgttgaaaaaagtctgtctttcagagatgatggatttgcttacaatgatacctgtctgcaagcattttttcccccaaaagtgcttaatagtaaaattagatcttgtagtagccgagattattgtatcatttatctgaaccacagcttttataaaatctttaaaggaaacaaatagggcccacatctttatgaataatttagaaacatttttgtatatatatgacaaatgaactgttttttttaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttgaaagattaaaaaaaaaaatgtttcttgaacacttttatatttatcagtttaaatattacattttttgcccaattttttttaaaatttttaaatggtagattatatgtcttaattttcctctaaagcccaatttgattaaaagtggtttgtgaacagtcattggct

SEQ ID NO: 287944 - DNA, 3354 bp, Homo sapiens
agacagtttcttccgcttcctgtaccacccggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatgaaatctttggaattaagagaaaaacaagctgaaaaggaagaaaagcagaaaacaaagaaaatagaaacaagtgcagaaaagttgcgtaagctcttaaaagaagagaagaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggagtgtactcctatttatttaaaaagttaactataaaacagcctcaggcaggtccttcaggagatattccagaagagggcattgttatcatagatgacagctccattcatgttactgaccctgaagaccttcaagtgggacaagatatggaggtggaagacagtggtattgatgatcctgaccacgggtaggcttaggtttatgtgtgtgtatgtgtcttagtttttaacaaaaaaattaaaaagtaaaaaaactaaaaatagaaaaatgcttagagaataaggatataaagaatatttttgtgcagttgaacaatgagtgcttaagctaaatgtcatcacaaaagagtaaaaaaattttacaaaattaaaaatgtttaaagttaaaaagctctaggaagctaaggtcaatttattattggagaaataaaattatttttatgaatttactgtagcctaggtgtacattatttatcatgtctacagtagtgttcagcaattaggccttcacattctctcaccactcactcactcagtcactcacccagagcagcttccagtcccgcaagctccatttatggtaagtgccctgtacaggtgtaccatttttttaatccattataccatatttttattgtaccttttctatgtttagatttgtttagatacacaagtaccactgtgttacagttgcctatagtactcagtacagtaacacactttacaagcttatagcctaggaacaataggctataccatctaggtttgtgtaagtacactcttatgatgttcacacagtgacaaaatcgcccaaggatgcattcatcagaacacattcccattgttatccaatgcatgactgtataatggttttatggattaaattttttatgtaattcaactggaaagtatttttatgttattttggaaaaaataaaacaatgacaattgaaatcatggaatctgcaaagattcacag

SEQ ID NO: 287945 - DNA, 2902 bp, Homo sapiens
agacagtttcttccgcttcctgtaccacccggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatggtttgtatttgaacatggtgattcctccttcacttcaccttaacggaatgtctttatttgaattttatttgtaaaatgtgtcctgtttaaatttttcaatctttaaaaataatttttatgtactttttttttttttttaacctttcttgcactctgggtcatgggtaccactgcaatggcttcccctttttttatgggataccaactgcaatatggtcctcaatgctgttctggccatttcaatgactaatgccaaacatctgtatgactaatttttttatgttaaaaaaatactgtttaatgctggctctatggtgatttggttttactaaattgggtttctcgttgggggtggtcttttgaatactgggttttatatattctgctatttttaacgtgtggtttttttcgatatctgggttctaaaagaaatctttggaattaagagaaaaacaagctgaaaaggaagaaaagcagaaaacaaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttgaaagatta

SEQ ID NO: 287946 - DNA, 1751 bp, Homo sapiens
agacagtttcttccgcttcctgtaccacccggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaaccttctgggaacatttaaaatggttttcagatacacttatttttctat

SEQ ID NO: 287947 - DNA, 1083 bp, Homo sapiens
gataggatcaccacggtggtaacctctcacattgtcttctccacaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccagccaatgcacacagtagggcttggtgaatgctgctgagtgaatgagtaaataaactcttcaaggccaagggacagtggtctaattcaactctgtgtcccagcacctggcacaccagaagtgccatgctcagaaatgttggttacatgaatgaatgaaccatgaatgaatgaaaaatctgt

SEQ ID NO: 287948 - DNA, 1246 bp, Homo sapiens
gtggatgttcccccaggacagcgtgttctccccacagctgctgagttggcagaaccaaacttgccacccacccgtctcatttacagtaaatccagtgggttgcagaaataggacctgaaactgcctgagggcagcagggtggggggacagtgaggggacgggaaaggggccagcctgctggtccatgggaggggaccgtcaggggaaagcccttcccgcctctggggaagggaacttccgcttcggaccgagggcagtaggctctcggctcctggtcccactgctgctcagcccagtggcctcacaggacaccagcttcccaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccagccaatgcacacagtagggcttggtgaatgctgctgagtgaatgagtaaataaactcttcaaggcc

SEQ ID NO: 287949 - DNA, 1360 bp, Homo sapiens
gtggatgttcccccaggacagcgtgttctccccacagctgctgagttggcagaaccaaacttgccacccacccgtctcatttacagtaaatccagtgggttgcagaaataggacctgaaactgcctgagggcagcagggtggggggacagtgaggggacgggaaaggggccagcctgctggtccatgggaggggaccgtcaggggaaagcccttcccgcctctggggaagggaacttccgcttcggaccgagggcagtaggctctcggctcctggtcccactgctgctcagcccagtggcctcacaggacaccagcttcccaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccagccaatgcacacagtagggcttggtgaatgctgctgagtgaatgagtaaataaactcttcaaggccaagggacagtggtctaattcaactctgtgtcccagcacctggcacaccagaagtgccatgctcagaaatgttggttacatgaatgaatgaaccatgaatgaatgaaaaatctgt

SEQ ID NO: 287950 - DNA, 1513 bp, Homo sapiens
gtggatgttcccccaggacagcgtgttctccccacagctgctgagttggcagaaccaaacttgccacccacccgtctcatttacagtaaatccagtgggttgcagaaataggacctgaaactgcctgagggcagcagggtggggggacagtgaggggacgggaaaggggccagcctgctggtccatgggaggggaccgtcaggggaaagcccttcccgcctctggggaagggaacttccgcttcggaccgagggcagtaggctctcggctcctggtcccactgctgctcagcccagtggcctcacaggacaccagcttcccagccctgtcaggttgaaatcagcattgccaagaggctcagagaggttaaggcacttgcctgaggttatgcagccggtagcagatggggctttaaagtcaagtgggcctgactccatgttgcggaaagggactgctggaccgaaggagatggaaaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccagccaatgcacacagtagggcttggtgaatgctgctgagtgaatgagtaaataaactcttcaaggccaagggacagtggtctaattcaactctgtgtcccagcacctggcacaccagaagtgccatgctcagaaatgttggttacatgaatgaatgaaccatgaatgaatgaaaaatctgt

SEQ ID NO: 287951 - DNA, 1349 bp, Homo sapiens
gtggatgttcccccaggacagcgtgttctccccacagctgctgagttggcagaaccaaacttgccacccacccgtctcatttacagtaaatccagtgggttgcagaaataggacctgaaactgcctgagggcagcagggtggggggacagtgaggggacgggaaaggggccagcctgctggtccatgggaggggaccgtcaggggaaagcccttcccgcctctggggaagggaacttccgcttcggaccgagggcagtaggctctcggctcctggtcccactgctgctcagcccagtggcctcacaggacaccagcttcccaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccagccaatgcacacagtagggcttggtgaatgctgctgagtgaatgagtaaataaactcttcaaggcccaagcccccccccccccaccccccacccccctccttcctctcccatcccccctccttcctcctacatctccccccatatccccttccctcctttcatcacccc

SEQ ID NO: 287952 - DNA, 888 bp, Homo sapiens
tacgcattatgggagtgtggcaagaaataaaatacctgagcaaccttatcccagtatgcatttcataccaggatcaagtcactaatgacagccaagttccaggcttatctatggctgcctaatgagactggccccactaggatggggactggggaggggacacacatgagtgcccaagcttcagtctacacctccccccttcagccagaagtgcgcctgggtgcgcacccaggcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccagccaatgcacacagtagggcttggtgaatgctgctgagtgaatgagtaaataaactcttcaaggccaagggacagtggtctaattcaactctgtgtcccagcacctggcacaccagaagtgccatgctcagaaatgttggttacatgaatgaatgaaccatgaatgaatgaaaaatctgt

SEQ ID NO: 287953 - DNA, 1313 bp, Homo sapiens
gtggatgttcccccaggacagcgtgttctccccacagctgctgagttggcagaaccaaacttgccacccacccgtctcatttacagtaaatccagtgggttgcagaaataggacctgaaactgcctgagggcagcagggtggggggacagtgaggggacgggaaaggggccagcctgctggtccatgggaggggaccgtcaggggaaagcccttcccgcctctggggaagggaacttccgcttcggaccgagggcagtaggctctcggctcctggtcccactgctgctcagcccagtggcctcacaggacaccagcttcccaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccagccaatgcacacagtagggcttggtgaatgctgctgagtgaatgagtaaataaactcttcaaggccaagggacagtggtctaattcaactctgtgtcccagcacctggcacaccagaagtgccatgctcagaaatgttggttacatgaatgaatgaaccatgaatgaatgaaaaatctgt

SEQ ID NO: 287954 - DNA, 1169 bp, Homo sapiens
gtggatgttcccccaggacagcgtgttctccccacagctgctgagttggcagaaccaaacttgccacccacccgtctcatttacagtaaatccagtgggttgcagaaataggacctgaaactgcctgagggcagcagggtggggggacagtgaggggacgggaaaggggccagcctgctggtccatgggaggggaccgtcaggggaaagcccttcccgcctctggggaagggaacttccgcttcggaccgagggcagtaggctctcggctcctggtcccactgctgctcagcccagtggcctcacaggacaccagcttcccaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccctgacctgtgggctgcttcacatccaccccggctccccctgccagcaacgctcactctacccccaacaccaccccttgcccagccaatgcacacagtagggcttggtgaatgctgctgagtgaatgagtaaataaactcttcaaggcc

SEQ ID NO: 287955 - DNA, 1231 bp, Homo sapiens
gtggatgttcccccaggacagcgtgttctccccacagctgctgagttggcagaaccaaacttgccacccacccgtctcatttacagtaaatccagtgggttgcagaaataggacctgaaactgcctgagggcagcagggtggggggacagtgaggggacgggaaaggggccagcctgctggtccatgggaggggaccgtcaggggaaagcccttcccgcctctggggaagggaacttccgcttcggaccgagggcagtaggctctcggctcctggtcccactgctgctcagcccagtggcctcacaggacaccagcttcccaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccagccaatgcacacagtagggcttggtgaatgctgctgagtgaatgagtaaataaactcttcaaggccaagggacagtggtctaattcaactctgtgtcccagcacctggcacaccagaagtgccatgctcagaaatgttggttacatgaatgaatgaaccatgaatgaatgaaaaatctgt

SEQ ID NO: 287956 - DNA, 1039 bp, Homo sapiens
caggggacaaatggggaaaaaagttctcaaaataaaaaagagaaatatggtagttttaagatgaggataagctaggcagcattttcaggggcacctgtagccatcgtggttgaaggatttgaattgggaaagttcctttgggtttttccaaaaggtgctgttaccttgtatagatatccacctatctattcacatggaccagcaaacgggacttctctctctatcgatataaatgtctagaatgaacactggatgcataaaataaactgatctgttcagacaactattttcaaatagtttttttttgcatctttcttagaagaactgttttgttaatgctaagaggtaaatgctgcttattataacctataatcacagctctgctttgtagaaaaatcaactttctgcaactcatagatcttgctgaaacactgttcttgtgattttagtacaacttttactttcttttataaagtataaaatctcacactgaagacaacagtagcccttgtgtttgctagtatggggattgtccactaagggacagctaaaagaactgaaatagttaatgcttgggagatctgagagtgggcaactgtgggatgtgattccttttaaggtaaaatcaacaggccacttactttatgtccaaaagaaaaattaggcatatccagttcattcttctctcagtgcctaggatttaatagattggaatacatttcaaaaataaagaattgccttgaactgggtaactgatttgatgtaaatgcccaaaggagaaggagtaaaaggaaaatgacatagagtctgagctagagtaacagggacagtattaattaatattaaccaaatatcaaataagaacatttaagagacgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctca

SEQ ID NO: 287957 - DNA, 765 bp, Homo sapiens
ctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatggtagggtctgcctgttccaaattctgttataaatcctttgttgcttattccaaaatttagaacatagaatagctgattagaacaagaaaagtttagggcaacacatgtgctccgattttattacttaagatatcttaattttcttttgactctaaggataactttttaa

SEQ ID NO: 287958 - DNA, 6026 bp, Homo sapiens
  misc_feature (1966)..(1966): n is a, c, g, or t
ctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaagttgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgttgatagagatgaaaattttaaaaagaagctcaaagaaaaaaacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggtaaaaaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagatcgtaaacgaagtgccagtgcacccaccctagctgaaacagaaaaagagacagcagngcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccattttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctca

SEQ ID NO: 287959 - DNA, 6264 bp, Homo sapiens
  misc_feature (1966)..(1966): n is a, c, g, or t
ctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaagttgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgttgatagagatgaaaattttaaaaagaagctcaaagaaaaaaacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggtaaaaaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagatcgtaaacgaagtgccagtgcacccaccctagctgaaacagaaaaagagacagcagngcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccattttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctcatttttattgcccttatttcattttccgttgttcatagtaacaggctttgtttctgacatagaaaataacacaatctctttataaactgccataaatttgttcgaatggagtttataatgtgtatcaacagataggaatttgaggcctttgtttgagaagcttttgtaggaaaagaagcaactgagctggggaatgaagaatcatggcagaaggtaaaagaaacaaaaacaaacaaaaa

SEQ ID NO: 287960 - DNA, 5940 bp, Homo sapiens
  misc_feature (1966)..(1966): n is a, c, g, or t
ctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaagttgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgttgatagagatgaaaattttaaaaagaagctcaaagaaaaaaacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggtaaaaaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagatcgtaaacgaagtgccagtgcacccaccctagctgaaacagaaaaagagacagcagngcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctca

SEQ ID NO: 287961 - DNA, 5252 bp, Homo sapiens
  misc_feature (1966)..(1966): n is a, c, g, or t
ctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaagttgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgttgatagagatgaaaattttaaaaagaagctcaaagaaaaaaacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggtaaaaaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagatcgtaaacgaagtgccagtgcacccaccctagctgaaacagaaaaagagacagcagngcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattttttattcaggatggtataacctaactgataataggtaataaggttaaatttttttatgacgtattttatttacaaatatcatacactgctggtgttaccatatgaaaggaaataaagtcaattgataattgcctca

SEQ ID NO: 287962 - DNA, 6053 bp, Homo sapiens
  misc_feature (1993)..(1993): n is a, c, g, or t
ctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaagttgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaatctttaatggccaaactttctagcatgaaaatcaaggtgggtcagatgcagtatgaaaagcagcggatggaacaaaaatgggagtcactgaaggatgaactggcatctttaaaagaacaactagaagaaaaggaatctgaagtaaaaaggctacaagaaaaattggtttgcaagatgaaaggagaaggggttgaaattgttgatagagacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggtaaaaaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagctgaaacagaaaaagagacagcagngcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccattttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctca

SEQ ID NO: 287963 - DNA, 5722 bp, Homo sapiens
  misc_feature (1662)..(1662): n is a, c, g, or t
gacaggcatcccctccgtcgtgctacagcgttagagcagatagatggtatcatcgacaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaagttgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaatctttaatggccaaactttctagcatgaaaatcaaggtgggtcagatgcagtatgaaaagcagcggatggaacaaaaatgggagtcactgaaggatgaactggcatctttaaaagaacaactagaagaaaaggaatctgaagtaaaaaggctacaagaaaaattggtttgcaagatgaaaggagaaggggttgaaattgttgatagagacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggtaaaaaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagctgaaacagaaaaagagacagcagngcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccattttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctca

SEQ ID NO: 287964 - DNA, 5960 bp, Homo sapiens
  misc_feature (1900)..(1900): n is a, c, g, or t
ctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaagttgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgttgatagagacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggtaaaaaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagctgaaacagaaaaagagacagcagngcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccattttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctca

SEQ ID NO: 287965 - DNA, 6381 bp, Homo sapiens
  misc_feature (2321)..(2321): n is a, c, g, or t
ctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaagttgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagtaagtttttctcacaggttaacattttcaaacaaatggcatcactattcatctatgcccaataatataaataagatgttttctacttaatgtatgataaagaaggtattttaaaagtaaatgaagatttccccccaagctggaaaccttgaatttaaacaccactgatctgaatttaaaaacaaggcttaactcatccgacagaacataacctgccctttctctgagttgtatctaacctcctttataaactgatactgttttctcggttatttagcttgtctttttctatctgtagttttctttcactcctctgtctctctaccagtctttaatggccaaactttctagcatgaaaatcaaggtgggtcagatgcagtatgaaaagcagcggatggaacaaaaatgggagtcactgaaggatgaactggcatctttaaaagaacaactagaagaaaaggaatctgaagtaaaaaggctacaagaaaaattggtttgcaagatgaaaggagaaggggttgaaattgttgatagagacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggtaaaaaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagctgaaacagaaaaagagacagcagngcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccattttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctca

SEQ ID NO: 287966 - DNA, 5963 bp, Homo sapiens
  misc_feature (1903)..(1903): n is a, c, g, or t
ctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaagttgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgttgatagagacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggtaaaaaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagatcgtaaacgaagtgccagtgcacccaccctagctgaaacagaaaaagagacagcagngcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccattttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctca

SEQ ID NO: 287967 - DNA, 1091 bp, Homo sapiens
ctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaagttgaatgccacagaagaaatgctgcagcaggtatgtgcagaggccagaaccaagatgggatttccctgctgaactatgtgagatgctgcatttctatgttgtgtttgctctgatgcagcagtaagtttcttgattcacttagaccagcacattaaaaaaaaaaaattgagagtagtagagtctcaaaacacatgcacacaatataaagtgtttatgtaattagaatctggaacaaaatgtcaataggattgtggcttattttaattttctttttttgcattcagatggtttcctctcacccatagcatgtgttttataattaag

SEQ ID NO: 287968 - DNA, 3010 bp, Homo sapiens
  misc_feature (1900)..(1900): n is a, c, g, or t
ctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaagttgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgttgatagagacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggtaaaaaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagctgaaacagaaaaagagacagcagngcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaacccagtcaatttgtggtaaacgtaatgagtagctggtggcgc

SEQ ID NO: 287969 - DNA, 2887 bp, Homo sapiens
  misc_feature (1900)..(1900): n is a, c, g, or t
ctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaagttgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgttgatagagacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggtaaaaaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagctgaaacagaaaaagagacagcagngcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaacccagtcaatttgtggtaaacgtaatgagtagctggtggcgc

SEQ ID NO: 287970 - DNA, 1050 bp, Homo sapiens
gagatcgagctcggtaccaaaacatgaactacatcttatcgtcacgaaagaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccattttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctca

SEQ ID NO: 287971 - DNA, 925 bp, Homo sapiens
ctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaagttgaatgccacagaagaaatgctgcagcaggtatgtgcagaggccagaaccaagatgggatttccctgctgaactatgtgagatgctgcatttctatgttgccgcttaataataatcaaccacgcgcgtttcttgattcagtaggttttacgctttca

SEQ ID NO: 287972 - DNA, 222 bp, Homo sapiens
tcaggtgaggtagaagatgtccatcttttcagatttttccaaaagagaatatgggtgttaaatgtgccctttttaaagaataaatgaaagaaatcattaacatctttaccttaaaatatttcagtctggagagtaaataacttcttatcactgtcacacatgtgaactgaactgacttctgatttgatgttattttcagacatcgaagtacaaaaaatgaaa

SEQ ID NO: 287973 - DNA, 212 bp, Homo sapiens
gccaaaggagttaaaaagaaccatccctgtgtcccgggatcgttgccctcagaactgaaattagataaagtaagggacttagaaactgttctgcccttttgagagaagagaaaaatggttctgtatctttggaaaaattagtaaaaaatttataccagggattgagccctccaccttttagaaaaataggctaattctgtttttggaaaaaa

SEQ ID NO: 287974 - DNA, 742 bp, Homo sapiens
tcatttctctttctcagaaacgaaggtgaatgacttaggggaatttagcaaaaaatgcctccgtggatttaatttagtgttgtgaagatatatagactctcaccctgctctctcctgtggtataaacttagcggaaagacctaaaatcatgattccctttgacttcatcatggagtttcccatctgttgtgatagtggataaattaacattgacgttgagcctgtgtgtaacatcagaagcactgtgtgccgcatgcctctcctccacggtgtgtatttggcgaggaggagtctgatctgcatttcattttgtcatctctgtgttctctccattgggctgcgtgtgattgtgtgcgttgttgggatatctgaagatcgtaaacgaagtgccagtgcacccaccctaggtattgtacccctgcatgccagccttcaccagcactgtgctccaaaccaatctaatccctgctcttggcatctgtgatctctagaaagcgatctgacagcaatcagaaaatgtagttctctattccggagtgttctttccaccttctgctaaaaaggactctgtagaggctttgcttccaagcctaaatgctgttttaaccaatactagtaacactcactgtgtgaatagctttgagaggacctagacgtgtgcagcatccctcagagtgcagggcaggaatgtcctggcattgtacattgcagctctttcagccttgaagtgcatattaccaca

SEQ ID NO: 287975 - DNA, 572 bp, Homo sapiens
catccctgttgccctttacagaggcctagagttctagagaacagcatggaaaccatgctagtggattttaaacacctcaagtgcaagaatggaatcttctttattaactgatacaggtatcgcatgtggtcttgtgctacagtaggtgattggccacagcttgctactccactactgaagttcttcttccatatttgactacacagcagagttatcatttgaaggtgaattagaaacccactagcaagcctatgtcatttaatggatgtaatgataaccttattttttttcagatctgggttggaatttgcccctgacaaataataaaatgatgagtgatgcaagtgacatgttggctgcagcgttggagcagatggatggtatcatagcaggtgatctgcatcctgtgaaagacagaatcacaacatttactctcctcacttggctttttcactacaactttcatattatcttttcactttattttcattttttagacctatgccttttgcttccctgtaatttcatctttgttcctcttctccattttctgccagcattattctcaaaca

SEQ ID NO: 287976 - DNA, 191 bp, Homo sapiens
tggggtaaataattaaattatacatataggagggagggggcaacgcaaaaaaaaatcacatgttatcaggccttgattatatgaattttatcaaatcctttggatgtttttgtttgcttttcttttaaagccaaagaaacttgcctttagcaattttgggaatttgagaaagaagaaacaggaagatggtg

SEQ ID NO: 287977 - DNA, 389 bp, Homo sapiens
aggagtaaaaggaaaatgacatagagtctgagctagagtaacagggacagtattaattaatattaaccaaatatcaaataagaacatttaagagacgaggccaggcgtggtggctcacgcctgtaatctcagcactttgggaggccgaggtgggtggatcacgaggtcaggagttcaagaccagcctggccaagatggtgaaaccctgtctctactaaaaatacaaaaattagccaggtgtggtggcgggtgcctgtaatcccagctacctgggacactgaggcagagaattgcttgaacccagtaggcggaggttgcagtaagccgagatcatgtcactgcactccagcctgggaaacagagtgagactctgtctcaaaaaaaaaaaa

SEQ ID NO: 287978 - DNA, 2518 bp, Homo sapiens
  misc_feature (2063)..(2063): n is a, c, g, or t
  misc_feature (2211)..(2211): n is a, c, g, or t
  misc_feature (2213)..(2213): n is a, c, g, or t
  misc_feature (2363)..(2363): n is a, c, g, or t
  misc_feature (2400)..(2400): n is a, c, g, or t
  misc_feature (2406)..(2406): n is a, c, g, or t
ctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaagttgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgttgatagaggtaagaagatatatttcacatttatcatctcattttgttaaagtcctccaaaatctgtaaaggaaaccaatgaaaatcaatgtgtagttttagcatcaaagaaagagcagcagaatccagccaggaccagaaccacaggggattctccaagactctttactgtgactgggaatccattaatttcctcttcagcagctggaaaaggggaattctgtactttatttggtgtttaagattgctagactgtaaattctcatcacaaggatggacttgtctcaattgcgatgcaagggaatttgtgccaaaggagttaaaaagaaccatccctgtgtcccgggatcgttgccctcagaactgaaattagataaagtaagggacttagaaaaatggttctgtatctttggaaaaattagtaaaaaatttataccagggattgagccctccaccttttagaaaaataggctaattctgtttttggaaaaaatgcatgaatttgtccaaacttttttcataacagcagaggtttgttctgagtattatatggaccataatttctaacaaagcagattgtgcatgatagaaaatagcccgaatgaaatacatttttaaaattatatttggaaatataatgtgcataatatctgacaacactaggttaaatttaacctttctttgttattacgaatgatgactgtggccctatgagataccaaagcaatttctgagtcattcaaaacagtacaaattccagttagcgtagctttgttacatttttatccattttatgaacattagtaacattgtctgtccaatgagggacttgagttagattatctctaaagtccttcttggctctagaataccatggccttatacccctgcaggtatcacaattccctgtccgtcagaaaattcatcaagcctgnggaaaatggattctcaccaccaaccgcttcaccgccccaccccatcacctactgtttggcatatatataattgtgtattgataagggacattcagaaacaggtcatactgatcatgctttcagggttttaagaataaaatgggctggntncagtggctcacacctgtaattccagtactttggaaggctgaggaaggaggatcgcttgaggccaggagttcaagaccagcctgggcaacacaatgagaccctgtctctacaaaaaatttctttttaagatttgaaatttttaaatttcanatttcaccaggcatggtggctcactcctgtaatcccncctacntgggaggctgaggagggaggatcacttaaggcccaggagttcgaggctgtagtgagctatgactgtgtcactgcacttcagcctgggcaaggagcaagatcctgtctctgaa

SEQ ID NO: 287979 - DNA, 1516 bp, Homo sapiens
ctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaagttgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagtaagtttttctcacaggttaacattttcaaacaaatggcatcactattcatctatgcccaataatataaataagatgttttctacttaatgtatgataaagaaggtattttaaaagtaaatgaagatttccccccaagctggaaaccttgaatttaaacaccactgatctgaatttaaaaacaaggcttaactcatccgacagaacataacctgccctttctctgagttgtatctaacctcctttataaactgatactgttttctcggttatttagcttgtctttttctatctgtagttttctttcactcctctgtctctctaccagtctttaatggccaaactttctagcatgaaaatcaaggtgggtcagatgcagtatgaaaagcagcggatggaacaaaaatgggagtcactgaaggtgtagtagacgttgggtgatggggtccatggcctgttgctttctggcttgtgttgttttgctgtgatgatgt

SEQ ID NO: 287980 - DNA, 975 bp, Homo sapiens
acactcgcctgggtctccggttggcggctcggacggagttcatttgccgggctgaggtggcggcgttggcggagggacacacacacgcacacgcacagcgagcttcggggcaggagaaaggggtcccacaaactgcaaggaaaagaaaaaccctcaacaggaattacctttatacctgatgcccccaacataatctctctccaagggaaacgtgtttttattgccttgcggctgaaaatgtattctcgattctcccccttctctcttttgttgtgcattttttggatgtggtaaaactggcagtttatctgattatctggttttcagaactttgggcgatgtctctgagtgtcatcagttgctctctaggtttgacatagataattaagcaactacaaagcgtgataaagcttttgagagggaggaaaatgtattttggaaggagggagagacgcaaagaggcgagcctgtgtgttgagtcccagacttggtgtgtgactacaggcaaagtacttcacctttctagatgtcagccccgcccccctcacctcccaagtttaaataagaacttattttagactacatgatcctgttttcaatttttaagagttctgtgattttgagatgatctctctttagtccagaaaaatagagaaacgtaggtctatgtttgtttctcaaaaaaatatttgaggaggacagctgttacaaaacagctggagaactccaaatttttatggtggttagctaggtgcaaatgggtacaattttaggtttgttcaaataaacataggggaaaagtaaaagtacaggaaaattacgttatacatataagtgtgtccatcatttctgatttttctaaaaatttacttttttatttgacaagtactttttggctccttccgtgtatgcattaatatgtatataaggtgttatgggaaatactaataaaaggaaaatattgggcataaagag

SEQ ID NO: 287981 - DNA, 941 bp, Homo sapiens
ggcggcggcggcggcggctgaagagacagatcccggtcccgccgactcgcgagcggcgtctccggcagcggggggagtgggcgggcgggtcccacaaactgcaaggaaaagaaaaaccctcaacaggaattacctttatacctgatgcccccaacataatctctctccaagggaaacgtgtttttattgccttgcggctgaaaatgtattctcgattctcccccttctctcttttgttgtgcattttttggatgtggtaaaactggcagtttatctgattatctggttttcagaactttgggcgatgtctctgagtgtcatcagttgctctctaggtttgacatagataattaagcaactacaaagcgtgataaagcttttgagagggaggaaaatgtattttggaaggagggagagacgcaaagaggcgagcctgtgtgttgagtcccagacttggtgtgtgactacaggcaaagtacttcacctttctagatgtcagccccgcccccctcacctcccaagtttaaataagaacttattttagactacatgatcctgttttcaatttttaagagttctgtgattttgagatgatctctctttagtccagaaaaatagagaaacgtaggtctatgtttgtttctcaaaaaaatatttgaggaggacagctgttacaaaacagctggagaactccaaatttttatggtggttagctaggtgcaaatgggtacaattttaggtttgttcaaataaacataggggaaaagtaaaagtacaggaaaattacgttatacatataagtgtgtccatcatttctgatttttctaaaaatttacttttttatttgacaagtactttttggctccttccgtgtatgcattaatatgtatataaggtgttatgggaaatactaataaaaggaaaatattgggcataaagag

SEQ ID NO: 287982 - DNA, 625 bp, Homo sapiens
cttcggttcgccgtttcagcttcccccctaccccaaccttcacccgattttttttgagctgaaaaaaaagtggaacgagggagccaatctttggtaactcgggttttctgtggtaggtgggttcaaaatctgagctgtagggagcgctagagatttcgtgccctttagccaagctgagggtatttgcaaaccctgaagatttccgtctccgagctttgggcttggtaagcgaagtttggagtcggtgcctaatcgtatatcatctaaaccttgaaaaggctttgacctttggccaatttgatttgttctttgaagaagtgtatacaatgtgtgggaaaataatatgtgagaggagagaagtaaatgtgttgatgttgtgattgtttatgtgatttaatttttaattttttttttttaggtcccacaaactgcaaggaaaagaaaaaccctcaacaggaattacctttatacctgatgcccccaacataatctctctccaagggaaacgtgtttttattgccttgcggctgtctggcagttatctgaatatctgttttcagactttggcgatgttctgagtgtatcagtgctcttaggttgacatgataataagcactacgcgtgt

SEQ ID NO: 287983 - DNA, 708 bp, Homo sapiens
cttcggttcgccgtttcagcttcccccctaccccaaccttcacccgattttttttgagctgaaaaaaaagtggaacgagggagccaatctttggtaactcgggttttctgtggtaggtgggttcaaaatctgagctgtagggagcgctagagatttcgtgccctttagccaagctgagggtatttgcaaaccctgaagatttccgtctccgagctttgggcttggtaagcgaagtttggagtcggtgcctaatcgtatatcatctaaaccttgaaaaggctttgacctttggccaatttgatttgttctttgaagaagtgtatacaatgtgtgggtgatttaatttttaattttttttttttaggtcccacaaactgcaaggaaaagaaaaaccctcaacaggaattacctttatacctgatgcccccaacataatctctctccaagggaaacgtgtttttattgccttgcggctgaaaatgtattctcgattctcccccttctctcttttgttgtgcattttttggatgtggtaaaactggcagtttatctgattatctggttttcagaactttgggcgatgtctctgagtgtcatcagttgctctctaggtttgacatagataattaagcaactacaaagcgtgataaagctttagtagggttaattgggggggatcgtctagagtcgaaaggggcatccaaatgc

SEQ ID NO: 287984 - DNA, 762 bp, Homo sapiens
cttcggttcgccgtttcagcttcccccctaccccaaccttcacccgattttttttgagctgaaaaaaaagtggaacgagggagccaatctttggtaactcgggttttctgtggtaggtgggttcaaaatctgagctgtagggagcgctagagatttcgtgccctttagccaagctgagggtatttgcaaaccctgaagatttccgtctccgagctttgggcttggtaagcgaagtttggagtcggtgcctaatcgtatatcatctaaaccttgaaaaggctttgacctttggccaatttgatttgttctttgaagaagtgtatacaatgtgtgggaaaataatatgtgagaggagagaagtaaatgtgttgatgttgtgattgtttatgtgatttaatttttaattttttttttttaggtcccacaaactgcaaggaaaagaaaaaccctcaacaggaattacctttatacctgatgcccccaacataatctctctccaagggaaacgtgtttttattgccttgcggctgaaaatgtattctcgattctcccccttctctcttttgttgtgcattttttggatgtggtaaaactggcagtttatctgattatctggttttcagaactttgggcgatgtctctgagtgtcatcagttgctctctaggtttgacatagataattaagcaactacaaagcgtgataaagctttagtagggttaattgggggggatcgtctagagtcgaaaggggcatccaaatgc

SEQ ID NO: 287985 - DNA, 400 bp, Homo sapiens
tccggacgacgctgcacctttgtttggggggggttaaactattaaccaccgctcaggtcccacaaactgcaaggaaaagaaaaaccctcaacaggaattacctttatacctgatgcccccaacataatctctctccaagggaaacgtgtttttattgccttgcggctgaaaatgtattctcgattctcccccttctctcttttgttgtgcattttttggatgtggtaaaactggcagtttatctgattatctggttttcagaactttgggcgatgtctctgagtgtcatcagttgctctctaggtttgacatagataattaagcaactacaaagcgtgataaagctttagtagggttaattgggggggatcgtctagagtcgaaaggggcatccaaatgc

SEQ ID NO: 287986 - DNA, 437 bp, Homo sapiens
cttcggttcgccgtttcagcttcccccctaccccaaccttcacccgattttttttgagctgaaaaaaaagtggaacgagggagccaatctttggtcccacaaactgcaaggaaaagaaaaaccctcaacaggaattacctttatacctgatgcccccaacataatctctctccaagggaaacgtgtttttattgccttgcggctgaaaatgtattctcgattctcccccttctctcttttgttgtgcattttttggatgtggtaaaactggcagtttatctgattatctggttttcagaactttgggcgatgtctctgagtgtcatcagttgctctctaggtttgacatagataattaagcaactacaaagcgtgataaagctttagtagggttaattgggggggatcgtctagagtcgaaaggggcatccaaatgc

SEQ ID NO: 287987 - DNA, 704 bp, Homo sapiens
  misc_feature (668)..(668): n is a, c, g, or t
  misc_feature (688)..(688): n is a, c, g, or t
  misc_feature (700)..(700): n is a, c, g, or t
cttcggttcgccgtttcagcttcccccctaccccaaccttcacccgattttttttgagctgaaaaaaaagtggaacgagggagccaatctttggtaactcgggttttctgtggtaggtgggttcaaaatctgagctgtagggagcgctagagatttcgtgccctttagccaagctgagggtatttgcaaaccctgaagatttccgtctccgagctttgggcttggtaagcgaagtttggagtcggtgcctaatcgtatatcatctaaaccttgaaaaggctttgacctttggccaatttgatttgttctttgaagaagtgtatacaatgtgtgggtgatttaatttttaattttttttttttaggtcccacaaactgcaaggaaaagaaaaaccctcaacaggaattacctttatacctgatgcccccaacataatctctctccaagggaaacgtgtttttattgccttgcggctgaaaatgtattctcgattctcccccttctctcttttgttgtgcattttttggatgtggtaaaactggcagtttatctgattatctggttttcagaactttgggcgatgtctctgagtgtcatcagttgctctctaggtttgacatagataattaagcaactacaaagcgtgataaagctttagtagggtaatnggggggatctcagagcgacngcaggcagcaanatgc

SEQ ID NO: 287988 - DNA, 1217 bp, Homo sapiens
cttcggttcgccgtttcagcttcccccctaccccaaccttcacccgattttttttgagctgaaaaaaaagtggaacgagggagccaatctttggtaactcgggttttctgtggtaggtgggttcaaaatctgagctgtagggagcgctagagatttcgtgccctttagccaagctgagggtatttgcaaaccctgaagatttccgtctccgagctttgggcttggtaagcgaagtttggagtcggtgcctaatcgtatatcatctaaaccttgaaaaggctttgacctttggccaatttgatttgttctttgaagaagtgtatacaatgtgtgggaaaataatatgtgagaggagagaagtaaatgtgttgatgttgtgattgtttatgtgatttaatttttaattttttttttttaggtcccacaaactgcaaggaaaagaaaaaccctcaacaggaattacctttatacctgatgcccccaacataatctctctccaagggaaacgtgtttttattgccttgcggctgaaaatgtattctcgattctcccccttctctcttttgttgtgcattttttggatgtgctgagtgtcatcagttgctctctaggtttgacatagataattaagcaactacaaagcgtgataaagcttttgagagggaggaaaatgtattttggaaggagggagagacgcaaagaggcgagcctgtgtgttgagtcccagacttggtgtgtgactacaggcaaagtacttcacctttctagatgtcagccccgcccccctcacctcccaagtttaaataagaacttattttagactacatgatcctgttttcaatttttaagagttctgtgattttgagatgatctctctttagtccagaaaaatagagaaacgtaggtctatgtttgtttctcaaaaaaatatttgaggaggacagctgttacaaaacagctggagaactccaaatttttatggtggttagctaggtgcaaatgggtacaattttaggtttgttcaaataaacataggggaaaagtaaaagtacaggaaaattacgttatacatataagtgtgtccatcatttctgatttttctaaaaatttacttttttatttgacaagtactttttggctccttccgtgtatgcattaatatgtatataaggtgttatgggaaatactaataaaaggaaaatattgggcataaagag

SEQ ID NO: 287989 - DNA, 1868 bp, Homo sapiens
attataaagattctgaacaacccaagagcatatacgttgcccatatccaaggaagaatcaagattatcaagactagcaacaaagactccaagcaaaggctaccaagaaacctcatgaagtgaaacaggactttgagaagttcctacataaactgcgttccgaagctgaaattgagagagaatgtgtggcatcactatcgtcatcatcatcatcatcaccatcatcaacagacaactacaactttgaggaagaagaatactaagagaaaccagaaatgaactctattcaagaataatgcatacaattcagtggtatcagtttaattgtaacaatatatttaattcaagtccaatccatgtaatcagtattaagagtgtgttttaccattcatctttaaaatcttcaaatcaataaatctcagtaagttattcttaaaagatctgtccaagcatgatcttggctcttaatagtaaaaccatattttaagatggaaaaagaatcattatgaagcatagagagctttcaaccatttctttgaaaatatatcttgatataatagcaaccgttcatcataatacaaaacagaaggaagattaatttactgtggcacagaaagtcctgccaattcctaagtgccccaagtagtttctctcagactttttacattttttcaggcctcaagcaaaaccaaagccccacctccaggtttggtagcaaacaaactttgcttctccggtgctaagcttccatcactcctctggtaataagctttgtgcacatttgctagaaagctgggcagcttgtccgcaggtaccattgatactgtgcagcctccccatcctgctccagtaagtcgtgacccttgagccccaaacttcctaaaacagtgaggaaaaaaatattagaacctataaatgaaaatacaagggatttgcttggtgtttgtagaacacatagcctatctaagttctaagaagaaaatacatgcggggtttttaggtgtcatcaaacattttaggacattaagacatttatactgtttcagagagtgatttggaattttttcattgtatctaaatctagtccctggttttgactccaagtggtaagtcaacagtactcctcccatttcatgactggcaataacccactgtaatattgattccataaagtagccacttgaagagttgtatagcaagcttacacgtaaatcaggaaggaggcgttaagataaaacaggcaatggtaaaagaaatgtaggcaaccctgaatcagaaggtcactccaaatgaggacaaatcaaaatttaaaatgtacagtcttatacaagttttccccaatggctatttcagctgcattcttaaggccgggctgtttcaaagaagaatcagtcccctagaacagatagcctagttcactgaataaacttatcaacaaaaagcttgttattaaactccaggttgggtcggtggttggttgaatctctaatggaaaattaaccaagcctttccacaaagcagagggcagtccctagaggtccacaccaccttccctgtgccttctggagctagtctgattattggactcagaagttgacatcagatgagatatatctgattgggatgataacaactatataaaggaccacacagctagagttaattttagttactgtaaaccaggcacagtttcaaacctaagatttcaaccaaagtgaaaggccctatcacaatgtacacagatcacttagctttaaaagatgcaatttatcctgacacgaaagttaacatgtacttacaattaattcttcttaataaaattcactccaaattactagtggattaaaggctctatgattaatttagcac

SEQ ID NO: 287990 - DNA, 1113 bp, Homo sapiens
atccaggttgttaaaaccgggcgaggactgcagcctcgagtccacctcccgactgaacaggtggttaactcgcccggggagaggaactgccagctcccgctttctgtttcacccgagggaccacgaacgccgccgccgccatgcttactacggagccgggaggaggagcccgaagtcggcgcgccgagtgcggctgcgcgggccccgccgacggagcccgcggccgggaccccgaacccccgcctcgagcccgccgcgccggggctctctcaccggaacgcgagtccccgcggggccaccggcgcgtggcggctgagcggccgcgtttggctcccggagcgcccacaccctctcgggcttccggctttctcccgaggcccggctgcgcctggcttgtggtagcatccgctgtggccaggctcggagctacactcaggaaaagtggagttaatggaggttcctagagacactcacacaattctcaatccacatttcaaaaggctcccctgagacgcaccctgtcggcccctttccgaaagcacgcgaacttaaggctggcaggtgctttaaaagacactcctcccaaggactaggaagcctctgaaatgggcttggaagtttctaatcccaaagacttcgaacccaggatctggatagcaagcaaaaatatttagatatttactcagttgaaaacgtggggggtggcttcgtggtctcttcgccagccaaatcgcgtggaaaaccacgacctcaatttttacaacagcacgaagacttacaagtgagcgtagcagcgacttcctggaacctcaaacaatgtgggacgctgcaataatgcctgagggcttttgacttacagttgccgccggagacctggggagggggtagtacttgggccggtgagtccaacctcaggaactgtcctttcaaaaatggtgatggatgtaacaagttgcatgtctgggctttatttcagtgtattaattgtgcgatcttttaaaatagctgtatttttaaaactgttttacagaaatctctttaaaatgtgattattctctatattcttaaagaatacaatggctaattaaatcctttgttgataactgactctca

SEQ ID NO: 287991 - DNA, 1274 bp, Homo sapiens
tccggaccctttcttcccatcctttgctcctaggattttacatgttgcctgcaaagggagtcaaacttagggggcaggcaaacaaacgagttctttccagcctctgtaaccggatcgctagagcgaaataaactcgcacaagtgtccagagatcgtagccagacagccagcctgcgcttgaagcaacttttaagtgaggctgcaagagccgccgggatgtagattttagttcgtggccaagcacaactacgacaccctgtccctgcccccaccccatccccaagaatgcatggaggaaggagagaggacgaggtgagggccgcctgcatttctgcacgtcggcgccggttagaaaccctgcagttttgagagagaagaagaggagatggaggggccaggagccacgactcccgggagagcgcagggaggggcgtgggtgccccttcgcccacctccgcccccgtcacctcgacagctgtcccgctcttggaattcattggcttcctctacccggcctcccaaacaccaccccaatctagtttagccccccgccccaccctcgctgacctaataaggccatgcagtgtgcgggggagctacataaaagcgcgggctcgcggcgactctgcaccacgcaggggaagagaaagcaggagccgtccagcacggaggaaggcgaccatggccaaggagtggggctacgccagtcacaacggtcctgaccactggcatgaacttttcccaaatgccaagggggaaaaccagtcgcccgttgagctgcatactaaagacatcaggcatgacccttctctgcagccatggtctgtgtcttatgatggtggctctgccaagaccatcctgaataatgggaagacctgccgagttgtatttgatgatacttatgataggtcaatgctgagagggggtcctctccctggaccctaccgacttcgccagtttcatcttcactggggctcttcggatgatcatggctctgagcacaccgtggatggagtcaagtatgcagcggaggtaagaggaactgccataatccattctcggtctcatacagtgaaaactgcaaaattaaaaataagaaccacagcaacaaagcatcatccactgcttttgtttcaagtctatagttatgaaaagagctgtactagttttagctgaactgaagctgctgaacattctaggctagacaggtaaaagggtataggtgagttggcatcaaacatgaagatttccaaggttatgttaagaaactgggg

SEQ ID NO: 287992 - DNA, 2563 bp, Homo sapiens
tccggaccctttcttcccatcctttgctcctaggattttacatgttgcctgcaaagggagtcaaacttagggggcaggcaaacaaacgagttctttccagcctctgtaaccggatcgctagagcgaaataaactcgcacaagtgtccagagatcgtagccagacagccagcctgcgcttgaagcaacttttaagtgaggctgcaagagccgccgggatgtagattttagttcgtggccaagcacaactacgacaccctgtccctgcccccaccccatccccaagaatgcatggaggaaggagagaggacgaggtgagggccgcctgcatttctgcacgtcggcgccggttagaaaccctgcagttttgagagagaagaagaggagatggaggggccaggagccacgactcccgggagagcgcagggaggggcgtgggtgccccttcgcccacctccgcccccgtcacctcgacagctgtcccgctcttggaattcattggcttcctctacccggcctcccaaacaccaccccaatctagtttagccccccgccccaccctcgctgacctaataaggccatgcagtgtgcgggggagctacataaaagcgcgggctcgcggcgactctgcaccacgcaggggaagagaaagcaggagccgtccagcacggaggaaggcgaccatggccaaggagtggggctacgccagtcacaacggtcctgaccactggcatgaacttttcccaaatgccaagggggaaaaccagtcgcccgttgagctgcatactaaagacatcaggcatgacccttctctgcagccatggtctgtgtcttatgatggtggctctgccaagaccatcctgaataatgggaagacctgccgagttgtatttgatgatacttatgataggtcaatgctgagagggggtcctctccctggaccctaccgacttcgccagtttcatcttcactggggctcttcggatgatcatggctctgagcacaccgtggatggagtcaagtatgcagcggagcttcatttggttcactggaacccgaagtataacacttttaaagaagccctgaagcagcgcgatgggatcgctgtgattggcatttttctgaagataggacatgagaatggcgagttccagattttccttgatgcattggacaagattaagacaaagggcaaggaggcgcccttcacaaagtttgacccatcctgcctgttcccggcatgccgggactactggacctaccagggctcattcaccacgccgccctgcgaggaatgcattgtgtggctgctgctgaaggagcccatgaccgtgagctctgaccagatggccaagctgcggagcctcctctccagtgctgagaacgagcccccagtgcctcttgtgagcaactggcgacctccacagcctatcaataacagggtggtgagagcttccttcaaatgaggctgctggatcttgccctcttcaggaaaggaaacctaccattggagagcttggttccttgcctccttctggtgctcttactccaagtctatttcatttttccacactgagcaatgaatgtgagagatgtggtcaccaagatctaagttacttgttgaaagaaagttactttcgacaagatctaatatgaaagcatagatttcacatttgatctctgtaataatcatctttcctataaaagtagcatttttggtaaagtttcaaagaagaagaaacagagatggaagagtaaagatatttttaaaatggctagctattgggcaccagtttttctgttatctaaaatttcacacaacttcattgtttttatttttatattatgagttgtccatcttaaagaaatatgagtaattctacatgtagtagaggtgtatgaagatcatataacaattaaacataagccagaaattaaaatgactatagacagcaagaattgagctaataatatgttttaactcttaacaccagcaagaagtcagtcatttattgaagttttagctactaagattacttggttttgattaccagtgaaaagaaaacacaatacaatcaggagttttcaaatttttgattcagtatttgaatttcttcttcataaatgtagttgaatttatcctagtatttttctttacctgaagtagggccatttatttttaatttcactacatttttctttgcatgattattaaaataaaaactgcctctgttgtgtttctcactggaggctggaatgaatgatcactagaacacaaaagagtgaatgatgacacttgaagtcaaagcagttgtactgatcaccagaaccaataaagacataaatggaaaacacacaaatcaaaaaaacaccaaaacaacaaaaatttgtgtgtgggcgcgccgcttcggcgccctgaagaaaaaaggtctttctaaggaccccttctgcggttggggccgagcgggcgcccataggacggcatcagcgcgaaccctgcgccaaaacagccgggccccaaaggagaacatcccggggcaggagcaaagcggcggggagtcccac

SEQ ID NO: 287993 - DNA, 2355 bp, Homo sapiens
tccggaccctttcttcccatcctttgctcctaggattttacatgttgcctgcaaagggagtcaaacttagggggcaggcaaacaaacgagttctttccagcctctgtaaccggatcgctagagcgaaataaactcgcacaagtgtccagagatcgtagccagacagccagcctgcgcttgaagcaacttttaagtgaggctgcaagagccgccgggatgtagattttagttcgtggccaagcacaactacgacaccctgtccctgcccccaccccatccccaagaatgcatggaggaaggagagaggacgaggtgagggccgcctgcatttctgcacgtcggcgccggttagaaaccctgcagttttgagagagaagaagaggagatggaggggccaggagccacgactcccgggagagcgcagggaggggcgtgggtgccccttcgcccacctccgcccccgtcacctcgacagctgtcccgctcttggaattcattggcttcctctacccggcctcccaaacaccaccccaatctagtttagccccccgccccaccctcgctgacctaataaggccatgcagtgtgcgggggagctacataaaagcgcgggctcgcggcgactctgcaccacgcaggggaagagaaagcaggagccgtccagcacggaggaaggcgaccatggccaaggagtggggctacgccagtcacaacggtcctgaccactggcatgaacttttcccaaatgccaagggggaaaaccagtcgcccgttgagctgcatactaaagacatcaggcatgacccttctctgcagccatggtctgtgtcttatgatggtggctctgccaagaccatcctgaataatgggaagacctgccgagttgtatttgatgatacttatgataggtcaatgctgagagggggtcctctccctggaccctaccgacttcgccagtttcatcttcactggggctcttcggatgatcatggctctgagcacaccgtggatggagtcaagtatgcagcggagcttcatttggttcactggaacccgaagtataacacttttaaagaagccctgaagcagcgcgatgggatcgctgtgattggcatttttctgaagataggacatgagaatggcgagttccagattttccttgatgcattggacaagattaagacaaagggcaaggaggcgcccttcacaaagtttgacccatcctgcctgttcccggcatgccgggactactggacctaccagggctcattcaccacgccgccctgcgaggaatgcattgtgtggctgctgctgaaggagcccatgaccgtgagctctgaccagatggccaagctgcggagcctcctctccagtgctgagaacgagcccccagtgcctcttgtgagcaactggcgacctccacagcctatcaataacagggtggtgagagcttccttcaaatgaggctgctggatcttgccctcttcaggaaaggaaacctaccattggagagcttggttccttgcctccttctggtgctcttactccaagtctatttcatttttccacactgagcaatgaatgtgagagatgtggtcaccaagatctaagttacttgttgaaagaaagttactttcgacaagatctaatatgaaagcatagatttcacatttgatctctgtaataatcatctttcctataaaagtagcatttttggtaaagtttcaaagaagaagaaacagagatggaagagtaaagatatttttaaaatggctagctattgggcaccagtttttctgttatctaaaatttcacacaacttcattgtttttatttttatattatgagttgtccatcttaaagaaatatgagtaattctacatgtagtagaggtgtatgaagatcatataacaattaaacataagccagaaattaaaatgactatagacagcaagaattgagctaataatatgttttaactcttaacaccagcaagaagtcagtcatttattgaagttttagctactaagattacttggttttgattaccagtgaaaagaaaacacaatacaatcaggagttttcaaatttttgattcagtatttgaatttcttcttcataaatgtagttgaatttatcctagtatttttctttacctgaagtagggccatttatttttaatttcactacatttttctttgcatgattattaaaataaaaactgcctctgttgtgtttctcactggaggctggaatgaatgatcactagaacacaaaagagtgaatgatgacacttgaagtcaaagcagttgtactgatcaccagaaccagctaccctggtcccgagctcgatca

SEQ ID NO: 287994 - DNA, 1272 bp, Homo sapiens
gatgtctagtgcgtcagcagggtcatgactgcatgctgggtaacaccgaccagatggccaagctgcggagcctcctctccagtgctgagaacgagcccccagtgcctcttgtgagcaactggcgacctccacagcctatcaataacagggtggtgagagcttccttcaaatgaggctgctggatcttgccctcttcaggaaaggaaacctaccattggagagcttggttccttgcctccttctggtgctcttactccaagtctatttcatttttccacactgagcaatgaatgtgagagatgtggtcaccaagatctaagttacttgttgaaagaaagttactttcgacaagatctaatatgaaagcatagatttcacatttgatctctgtaataatcatctttcctataaaagtagcatttttggtaaagtttcaaagaagaagaaacagagatggaagagtaaagatatttttaaaatggctagctattgggcaccagtttttctgttatctaaaatttcacacaacttcattgtttttatttttatattatgagttgtccatcttaaagaaatatgagtaattctacatgtagtagaggtgtatgaagatcatataacaattaaacataagccagaaattaaaatgactatagacagcaagaattgagctaataatatgttttaactcttaacaccagcaagaagtcagtcatttattgaagttttagctactaagattacttggttttgattaccagtgaaaagaaaacacaatacaatcaggagttttcaaatttttgattcagtatttgaatttcttcttcataaatgtagttgaatttatcctagtatttttctttacctgaagtagggccatttatttttaatttcactacatttttctttgcatgattattaaaataaaaactgcctctgttgtgtttctcactggaggctggaatgaatgatcactagaacacaaaagagtgaatgatgacacttgaagtcaaagcagttgtactgatcaccagaaccaataaagacataaatggaaaacacacaaatcaaaaaaacaccaaaacaacaaaaatttgtgtgtgggcgcgccgcttcggcgccctgaagaaaaaaggtctttctaaggaccccttctgcggttggggccgagcgggcgcccataggacggcatcagcgcgaaccctgcgccaaaacagccgggccccaaaggagaacatcccggggcaggagcaaagcggcggggagtcccac

SEQ ID NO: 287995 - DNA, 1205 bp, Homo sapiens
gaccacgcaggggaagagaaagcaggagcccccagtgcctcttgtgagcaactggcgacctccacagcctatcaataacagggtggtgagagcttccttcaaatgaggctgctggatcttgccctcttcaggaaaggaaacctaccattggagagcttggttccttgcctccttctggtgctcttactccaagtctatttcatttttccacactgagcaatgaatgtgagagatgtggtcaccaagatctaagttacttgttgaaagaaagttactttcgacaagatctaatatgaaagcatagatttcacatttgatctctgtaataatcatctttcctataaaagtagcatttttggtaaagtttcaaagaagaagaaacagagatggaagagtaaagatatttttaaaatggctagctattgggcaccagtttttctgttatctaaaatttcacacaacttcattgtttttatttttatattatgagttgtccatcttaaagaaatatgagtaattctacatgtagtagaggtgtatgaagatcatataacaattaaacataagccagaaattaaaatgactatagacagcaagaattgagctaataatatgttttaactcttaacaccagcaagaagtcagtcatttattgaagttttagctactaagattacttggttttgattaccagtgaaaagaaaacacaatacaatcaggagttttcaaatttttgattcagtatttgaatttcttcttcataaatgtagttgaatttatcctagtatttttctttacctgaagtagggccatttatttttaatttcactacatttttctttgcatgattattaaaataaaaactgcctctgttgtgtttctcactggaggctggaatgaatgatcactagaacacaaaagagtgaatgatgacacttgaagtcaaagcagttgtactgatcaccagaaccaataaagacataaatggaaaacacacaaatcaaaaaaacaccaaaacaacaaaaatttgtgtgtgggcgcgccgcttcggcgccctgaagaaaaaaggtctttctaaggaccccttctgcggttggggccgagcgggcgcccataggacggcatcagcgcgaaccctgcgccaaaacagccgggccccaaaggagaacatcccggggcaggagcaaagcggcggggagtcccac

SEQ ID NO: 287996 - DNA, 2090 bp, Homo sapiens
tccggaccctttcttcccatcctttgctcctaggattttacatgttgcctgcaaagggagtcaaacttagggggcaggcaaacaaacgagttctttccagcctctgtaaccggatcgctagagcgaaataaactcgcacaagtgtccagagatcgtagccagacagccagcctgcgcttgaagcaacttttaagtgaggctgcaagagccgccgggatgtagattttagttcgtggccaagcacaactacgacaccctgtccctgcccccaccccatccccaagaatgcatggaggaaggagagaggacgaggtgagggccgcctgcatttctgcacgtcggcgccggttagaaaccctgcagttttgagagagaagaagaggagatggaggggccaggagccacgactcccgggagagcgcagggaggggcgtgggtgccccttcgcccacctccgcccccgtcacctcgacagctgtcccgctcttggaattcattggcttcctctacccggcctcccaaacaccaccccaatctagtttagccccccgccccaccctcgctgacctaataaggccatgcagtgtgcgggggagctacataaaagcgcgggctcgcggcgactctgcaccacgcaggggaagagaaagcaggagccgtccagcacggaggaaggcgaccatggccaaggagtggggctacgccagtcacaacggtcctgaccactggcatgaacttttcccaaatgccaagggggaaaaccagtcgcccgttgagctgcatactaaagacatcaggcatgacccttctctgcagccatggtctgtgtcttatgatggtggctctgccaagaccatcctgaataatgggaagacctgccgagttgtatttgatgatacttatgataggtcaatgctgagagggggtcctctccctggaccctaccgaacagcctatcaataacagggtggtgagagcttccttcaaatgaggctgctggatcttgccctcttcaggaaaggaaacctaccattggagagcttggttccttgcctccttctggtgctcttactccaagtctatttcatttttccacactgagcaatgaatgtgagagatgtggtcaccaagatctaagttacttgttgaaagaaagttactttcgacaagatctaatatgaaagcatagatttcacatttgatctctgtaataatcatctttcctataaaagtagcatttttggtaaagtttcaaagaagaagaaacagagatggaagagtaaagatatttttaaaatggctagctattgggcaccagtttttctgttatctaaaatttcacacaacttcattgtttttatttttatattatgagttgtccatcttaaagaaatatgagtaattctacatgtagtagaggtgtatgaagatcatataacaattaaacataagccagaaattaaaatgactatagacagcaagaattgagctaataatatgttttaactcttaacaccagcaagaagtcagtcatttattgaagttttagctactaagattacttggttttgattaccagtgaaaagaaaacacaatacaatcaggagttttcaaatttttgattcagtatttgaatttcttcttcataaatgtagttgaatttatcctagtatttttctttacctgaagtagggccatttatttttaatttcactacatttttctttgcatgattattaaaataaaaactgcctctgttgtgtttctcactggaggctggaatgaatgatcactagaacacaaaagagtgaatgatgacacttgaagtcaaagcagttgtactgatcaccagaaccaataaagacataaatggaaaacacacaaatcaaaaaaacaccaaaacaacaaaaatttgtgtgtgggcgcgccgcttcggcgccctgaagaaaaaaggtctttctaaggaccccttctgcggttggggccgagcgggcgcccataggacggcatcagcgcgaaccctgcgccaaaacagccgggccccaaaggagaacatcccggggcaggagcaaagcggcggggagtcccac

SEQ ID NO: 287997 - DNA, 1806 bp, Homo sapiens
tccggaccctttcttcccatcctttgctcctaggattttacatgttgcctgcaaagggagtcaaacttagggggcaggcaaacaaacgagttctttccagcctctgtaaccggatcgctagagcgaaataaactcgcacaagtgtccagagatcgtagccagacagccagcctgcgcttgaagcaacttttaagtgaggctgcaagagccgccgggatgtagattttagttcgtggccaagcacaactacgacaccctgtccctgcccccaccccatccccaagaatgcatggaggaaggagagaggacgaggtgagggccgcctgcatttctgcacgtcggcgccggttagaaaccctgcagttttgagagagaagaagaggagatggaggggccaggagccacgactcccgggagagcgcagggaggggcgtgggtgccccttcgcccacctccgcccccgtcacctcgacagctgtcccgctcttggaattcattggcttcctctacccggcctcccaaacaccaccccaatctagtttagccccccgccccaccctcgctgacctaataaggccatgcagtgtgcgggggagctacataaaagcgcgggctcgcggcgactctgcaccacgcaggggaagagaaagcaggagccgtccagacagcctatcaataacagggtggtgagagcttccttcaaatgaggctgctggatcttgccctcttcaggaaaggaaacctaccattggagagcttggttccttgcctccttctggtgctcttactccaagtctatttcatttttccacactgagcaatgaatgtgagagatgtggtcaccaagatctaagttacttgttgaaagaaagttactttcgacaagatctaatatgaaagcatagatttcacatttgatctctgtaataatcatctttcctataaaagtagcatttttggtaaagtttcaaagaagaagaaacagagatggaagagtaaagatatttttaaaatggctagctattgggcaccagtttttctgttatctaaaatttcacacaacttcattgtttttatttttatattatgagttgtccatcttaaagaaatatgagtaattctacatgtagtagaggtgtatgaagatcatataacaattaaacataagccagaaattaaaatgactatagacagcaagaattgagctaataatatgttttaactcttaacaccagcaagaagtcagtcatttattgaagttttagctactaagattacttggttttgattaccagtgaaaagaaaacacaatacaatcaggagttttcaaatttttgattcagtatttgaatttcttcttcataaatgtagttgaatttatcctagtatttttctttacctgaagtagggccatttatttttaatttcactacatttttctttgcatgattattaaaataaaaactgcctctgttgtgtttctcactggaggctggaatgaatgatcactagaacacaaaagagtgaatgatgacacttgaagtcaaagcagttgtactgatcaccagaaccaataaagacataaatggaaaacacacaaatcaaaaaaacaccaaaacaacaaaaatttgtgtgtgggcgcgccgcttcggcgccctgaagaaaaaaggtctttctaaggaccccttctgcggttggggccgagcgggcgcccataggacggcatcagcgcgaaccctgcgccaaaacagccgggccccaaaggagaacatcccggggcaggagcaaagcggcggggagtcccac

SEQ ID NO: 287998 - DNA, 1005 bp, Homo sapiens
aagcagtgtatcaacgcagactgcccattacggccggggcaccaagatctaagttacttgttgaaagaaagttactttcgacaagatctaatatgaaagcatagatttcacatttgatctctgtaataatcatctttcctataaaagtagcatttttggtaaagtttcaaagaagaagaaacagagatggaagagtaaagatatttttaaaatggctagctattgggcaccagtttttctgttatctaaaatttcacacaacttcattgtttttatttttatattatgagttgtccatcttaaagaaatatgagtaattctacatgtagtagaggtgtatgaagatcatataacaattaaacataagccagaaattaaaatgactatagacagcaagaattgagctaataatatgttttaactcttaacaccagcaagaagtcagtcatttattgaagttttagctactaagattacttggttttgattaccagtgaaaagaaaacacaatacaatcaggagttttcaaatttttgattcagtatttgaatttcttcttcataaatgtagttgaatttatcctagtatttttctttacctgaagtagggccatttatttttaatttcactacatttttctttgcatgattattaaaataaaaactgcctctgttgtgtttctcactggaggctggaatgaatgatcactagaacacaaaagagtgaatgatgacacttgaagtcaaagcagttgtactgatcaccagaaccaataaagacataaatggaaaacacacaaatcaaaaaaacaccaaaacaacaaaaatttgtgtgtgggcgcgccgcttcggcgccctgaagaaaaaaggtctttctaaggaccccttctgcggttggggccgagcgggcgcccataggacggcatcagcgcgaaccctgcgccaaaacagccgggccccaaaggagaacatcccggggcaggagcaaagcggcggggagtcccac

SEQ ID NO: 287999 - DNA, 733 bp, Homo sapiens
  misc_feature (41)..(41): n is a, c, g, or t
actttgggatcaagctagagaccaaacatgcttccaattcnagggactctctgtcctaagatttatctttgtttctcaaaaattaagatctccagaagggtgctgaacgaggatgggtactcctccaccatcaaggacaagatcctgaccattgatgtgaagcccggttggaggcagggcacacgcatcacctttgagaaggaaggggaccagggccccaacatcatcccagcagacatcattttcatcgtaaaggagaagctacaccctcgcttccgcagggagaatgacaacctctttttcgtgaaccccatccctcttggcaaggctctcacctgctgcactgtggaggtgaggaccctagatgaccgtctgctcaacatccccatcaatgacatcatccaccccaaatacttcaagaaggtgccaggggaggggatgccattgccggaggaccccactaagaaaggggatctcttcatcttcttcgacatccagttccccacccgcctcacaccccagaagaagcagatgctgcgccaggcattgctgacatgactgtggtgggctggagcaggggtgagaggaggctagccgggcctcaccccacccctacccgccacagcctcagggtgtgcaggggagcctgctgcacagatatgatacaagggtgggatggcgcagggcttaaactgacataataaagatctatttcctgtcctccagctacacc

SEQ ID NO: 288000 - DNA, 3764 bp, Homo sapiens
tggggggccggggtggggtggggcaggatgctggatggcccactgttctccgaggggcctgacagcccccgggagctccaggatgaggagtctggcagctgcctctgggtgcagaagtccaagctattggtgatagaagtgaagactatttcctgtcattatagtcgccgcgccccttctcgacagcccatggacttccaggccagccactgggctcgcgggttccagaaccgcacgtgtgggccgcgcccgggatccccacagccgccgccccgccggccctgggcctccagggtgctgcaggaggcgaccaactggcgggcggggcccctggccgaggtccgagctcgggagcaagagaaaaggaaagcggcgtcgcaggagcgggaggccaaggagaccgagcgaaaaaggcgcaaggctggtggggcccgacggagccccccgggtcgaccccgcccggagccccgcaacgcccctcgggtggcccagctggcagggctccctgctcccttgcggccggagcgcctggcgcctgtggggcgagcgccccgtccatccgcgcagccgcagagcgacccagggtcggcgtgggcggggccctggggaggtcggcggcccgggcccccaagctacgaggctcacctgctgctgagaggttctgccgggaccgccccacgacgccgctgggaccggccgccaccctacgtggctccaccttcttacgaaggcccccataggaccttggggactaagagaggccccgggaactctcaggtgcccacttcatcagccccagctgcgactccagccaggacagacggagggcgcacaaagaagaggctggatcctcggatctaccgggacgtcctcggggcttggggtctccgacaggggcaaggtctcttggggggatccccaggctgtggagcggccagagcaaggccagagcccggcaagggggtcgtggagaaaagcctggggctggctgctgctgacctgaacagtggtagcgacagccatccccaagccaaagctacagggagcgcaggcaccgagatagctcctgcggggtctgcaactgcggctccctgtgccccgcatcccgctcccagatccaggcaccacctcaagggctcgagggaagggaaagaaggagaacagatctggtttcccaaatgctggattccctcccctaaaaagcagccgccccgccatagccagacactccccagaccctgggctcccggaggcaccggatggagagaatctctgggtcttggagagggggcaggaccggagaccctggagggttggaaggcgacccgccgtgcccacaccttgccccgcagttcccagggcctgtcccgtggggaaggcgtctttgtcattgacgccacgtgcgtagtgatacgatcccaatatgttccaaccccccgaacccagcaggtgcagcttttgccctctggggtgacacgcgtggtgggggattcccccagccaatcgaagcccggcaaggaggagggtgaaggggccacggtctttccttccccttgtcaaaagcggctgtcgagcagtcgccttttacaccagcccggcgggggccgcgggggcgaagctgagggcgggaggccgggggactccacactggaggagcgcactttccgcatcttggggctcccggcccccgaagtaaacctgcgggacgcccccacgcagccaggtagcccagagcaccaagccttaggcccagcagcttcgggagcccagggcagagccgaggggtcggaagtggcggtggtccagcggcgcgccggccggggctgggcgcggaccccagggccctacgccggggccctgcgagaagccgtgtcccgtatccgccgccacacagcccctgactcggacacggacgaagctgaggagctcagcgtccatagcggctcctctgatggaagcgacacagaagccccgggcgcctcctggcggaatgagaggaccctgcccgaggttggaaacagttcgccagaggaagatgggaagacagcggaactgagcgacagtgtcggggagatcctagatgtcataagccaaaccgaggaggtcctcttcggggtgagggacatcagagggacccaacagggaaataggaagaggcagtgagaggccccttcttgtatttgtgtccccaacgcatccatccttgggtccactggtccccattcttccccacagacttcctttgcttctcttttccttgtatctttacccatacctgttctcatccttgaaatataaatgaaaggaagggaagcatatgcccattaatgattttgtttcaggagaggtgagaatgagcagatttaattaatgtctgttatgttcagggcacaagggtgagctcttcgcaggggctgatgcactgggtgtggagctgagcagagaggcctaaccaggatcaggcaggagggcagggatggtggcagccataggagggcagggtagggtagggcctctgaggaggagggaaaaagtgaaggagaggctttggacctggtgacagagtgatcagatgacagaggggttcttgggagaagaggcataggtccagcaacaaccaacaaagcagaaggagggctcaccttggtgtcacaagtcttggatttcaatcccaactctgccactgagttgctggttgactgaggccagtcactttccctctccaggcctccaggcctcctggtatataaaatgatggtattctaaggtccatccttccgtctctgacattttgagatctttggaaaggactctatctcatcctcccctcgacaagccaagaatgagaattgggaataagtgaacagagtttgagggtttctgggcggcctccgtgtcacccaaagtcatgatcaattcaggagactgcccaaggcttgcagaagaggtaagggagtgaggcactcctatcccagtctcccaggtttggttgagggctccccaaggcagggcaagatagcggccctgtcactgaccctggcctgtggtggtctgagctggggagggaaggacaccaatgaatcagcttgggacctctttaggccttccccttttcctccaccccgatgctccttagtgatgctctgaggcgtggccacgatctccctcccaggtggtatcgcccacctgaaaaaatcctgagaatttcttccatcttggcctcttccagaaaccggccaggcaaggaaagaggccggtcaccagaagccagcaggcgtggggtgtgatactctctatagccactacagggcgcgcgcaggtcgcggatctccccagttgctaatcccggctctgccactcaatccgatccctagttcccgagcgcgggtcccccgccttgcagtctccagccgtgcggggccgggagcaggcctccggcctcccagacttctagagcccgccgggcccatctttgtactcatccaccccagccggcttgggactcagacaccgaagtctttttttttttctctccgatccttggacacctcctctgtctgccatttattagccatgtgaacttggccacatcacttcacctccctgagcctcagtttcctcatctgtcaaatgggggtttataaacacctacctcgcagggttgttgtgaggatttaatgcgataatgtatgtaaagcgccttgcacactgcctggcacacagtaggcgctcaataaatctaagcttccctttatccagccttg

SEQ ID NO: 288001 - DNA, 2858 bp, Homo sapiens
tggggggccggggtggggtggggcaggatgctggatggcccactgttctccgaggggcctgacagcccccgggagctccaggatgaggagtctggcagctgcctctgggtgcagaagtccaagctattggtgatagaagtgaagactatttcctgtcattatagtcgccgcgccccttctcgacagcccatggacttccaggccagccactgggctcgcgggttccagaaccgcacgtgtgggccgcgcccgggatccccacagccgccgccccgccggccctgggcctccagggtgctgcaggaggcgaccaactggcgggcggggcccctggccgaggtccgagctcgggagcaagagaaaaggaaagcggcgtcgcaggagcgggaggccaaggagaccgagcgaaaaaggcgcaaggctggtggggcccgacggagccccccgggtcgaccccgcccggagccccgcaacgcccctcgggtggcccagctggcagggctccctgctcccttgcggccggagcgcctggcgcctgtggggcgagcgccccgtccatccgcgcagccgcagagcgacccagggtcggcgtgggcggggccctggggaggtcggcggcccgggcccccaagctacgaggctcacctgctgctgagaggttctgccgggaccgccccacgacgccgctgggaccggccgccaccctacgtggctccaccttcttacgaaggcccccataggaccttggggactaagagaggccccgggaactctcaggtgcccacttcatcagccccagctgcgactccagccaggacagacggagggcgcacaaagaagaggctggatcctcggatctaccgggacgtcctcggggcttggggtctccgacaggggcaaggtctcttggggggatccccaggctgtggagcggccagagcaaggccagagcccggcaagggggtcgtggagaaaagcctggggctggctgctgctgacctgaacagtggtagcgacagccatccccaagccaaagctacagggagcgcaggcaccgagatagctcctgcggggtctgcaactgcggctccctgtgccccgcatcccgctcccagatccaggcaccacctcaagggctcgagggaagggaaagaaggagaacagatctggtttcccaaatgctggattccctcccctaaaaagcagccgccccgccatagccagacactccccagaccctgggctcccggaggcaccggatggagagaatctctgggtcttggagagggggcaggaccggagaccctggagggttggaaggcgacccgccgtgcccacaccttgccccgcagttcccagggcctgtcccgtggggaaggcgtctttgtcattgacgccacgtgcgtagtgatacgatcccaatatgttccaaccccccgaacccagcaggtgcagcttttgccctctggggtgacacgcgtggtgggggattcccccagccaatcgaagcccggcaaggaggagggtgaaggggccacggtctttccttccccttgtcaaaagcggctgtcgagcagtcgccttttacaccagcccggcgggggccgcgggggcgaagctgagggcgggaggccgggggactccacactggaggagcgcactttccgcatcttggggctcccggcccccgaagtaaacctgcgggacgcccccacgcagccaggtagcccagagcaccaagccttaggcccagcagcttcgggagcccagggcagagccgaggggtcggaagtggcggtggtccagcggcgcgccggccggggctgggcgcggaccccagggccctacgccggggccctgcgagaagccgtgtcccgtatccgccgccacacagcccctgactcggacacggacgaagctgaggagctcagcgtccatagcggctcctctgatggaagcgacacagaagccccgggcgcctcctggcggaatgagaggaccctgcccgaggttggaaacagttcgccagaggaagatgggaagacagcggaactgagcgacagtgtcggggagatcctagatgtcataagccaaaccgaggaggtcctcttcggggtgagggacatcagagggacccaacagggaaataggaagaggcagtgagaggccccttcttgtatttgtgtccccaacgcatccatccttgggtccactggtccccattcttccccacagacttcctttgcttctcttttccttgtatctttacccatacctgttctcatccttgaaatataaatgaaaggaagggaagcatatgcccattaatgattttgtttcaggagaggtgagaatgagcagatttaattaatgtctgttatgttcagggcacaagggtgagctcttcgcaggggctgatgcactgggtgtggagctgagcagagaggcctaaccaggatcaggcaggagggcagggatggtggcagccataggagggcagggtagggtagggcctctgaggaggagggaaaaagtgaaggagaggctttggacctggtgacagagtgatcagatgacagaggggttcttgggagaagaggcataggtccagcaacaaccaacaaagcagaaggagggctcacctcctctgtctgccatttattagccatgtgaacttggccacatcacttcacctccctgagcctcagtttcctcatctgtcaaatgggggtttataaacacctacctcgcagggttgttgtgaggatttaatgcgataatgtatgtaaagcgccttgcacactgcctggcacacagtaggcgctcaataaatctaagcttccctttatccagccttg

SEQ ID NO: 288002 - DNA, 2230 bp, Homo sapiens
  misc_feature (2134)..(2134): n is a, c, g, or t
  misc_feature (2162)..(2162): n is a, c, g, or t
tggggggccggggtggggtggggcaggatgctggatggcccactgttctccgaggggcctgacagcccccgggagctccaggatgaggagtctggcagctgcctctgggtgcagaagtccaagctattggtgatagaagtgaagactatttcctgtcattatagtcgccgcgccccttctcgacagcccatggacttccaggccagccactgggctcgcgggttccagaaccgcacgtgtgggccgcgcccgggatccccacagccgccgccccgccggccctgggcctccagggtgctgcaggaggcgaccaactggcgggcggggcccctggccgaggtccgagctcgggagcaagagaaaaggaaagcggcgtcgcaggagcgggaggccaaggagaccgagcgaaaaaggcgcaaggctggtggggcccgacggagccccccgggtcgaccccgcccggagccccgcaacgcccctcgggtggcccagctggcagggctccctgctcccttgcggccggagcgcctggcgcctgtggggcgagcgccccgtccatccgcgcagccgcagagcgacccagggtcggcgtgggcggggccctggggaggtcggcggcccgggcccccaagctacgaggctcacctgctgctgagaggttctgccgggaccgccccacgacgccgctgggaccggccgccaccctacgtggctccaccttcttacgaaggcccccataggaccttggggactaagagaggccccgggaactctcaggtgcccacttcatcagccccagctgcgactccagccaggacagacggagggcgcacaaagaagaggctggatcctcggatctaccgggacgtcctcggggcttggggtctccgacaggggcaaggtctcttggggggatccccaggctgtggagcggccagagcaaggccagagcccggcaagggggtcgtggagaaaagcctggggctggctgctgctgacctgaacagtggtagcgacagccatccccaagccaaagctacagggagcgcaggcaccgagatagctcctgcggggtctgcaactgcggctccctgtgccccgcatcccgctcccagatccaggcaccacctcaagggctcgagggaagggaaagaaggagaacagatctggtttcccaaatgctggattccctcccctaaaaagcagccgccccgccatagccagacactccccagaccctgggctcccggaggcaccggatggagagaatctctgggtcttggagagggggcaggaccggagaccctggagggttggaaggcgacccgccgtgcccacaccttgccccgcagttcccagggcctgtcccgtggggaaggcgtctttgtcattgacgccacgtgcgtagtgatacgatcccaatatgttccaaccccccgaacccagcaggtgcagcttttgccctctggggtgacacgcgtggtgggggattcccccagccaatcgaagcccggcaaggaggagggtgaaggggccacggtctttccttccccttgtcaaaagcggctgtcgagcagtcgccttttacaccagcccggcgggggccgcgggggcgaagctgagggcgggaggccgggggactccacactggaggagcgcactttccgcatcttggggctcccggcccccgaagtaaacctgcgggacgcccccacgcagccaggtagcccagagcaccaagccttaggcccagcagcttcgggagcccagggcagagccgaggggtcggaagtggcggtggtccagcggcgcgccggccggggctgggcgcggaccccagggccctacgccggggccctgcgagaagccgtgtcccgtatccgccgccacacagcccctgactcggacacggacgaagctgaggagctcagcgtccatagcggctcctctgatggaagcgacacagaagccccgggcgcctcctggcggaatgagaggaccctgcccgaggttggaaacagttcgccagaggaagatgggaagacagcggaactgagcgacagtgtcggggagatcctagatgtcataagagacagcggaactgagcgacagtgtcggggagatcctagatgtnatagccacggtctttccttccccttgtnaaaagcttctgtcgagcagtcgccttttacaccagcccgtcgggggcctcggggcgaagctgagggcg

SEQ ID NO: 288003 - DNA, 877 bp, Homo sapiens
ctgtgtgaggcagactcagctcccaagcctgtctcaggcagcaggcagcccccgtgtgctggccatcccagctagcaggctggggtcctagagaatcgctaacctccaggaaaacagcctcctgtcgcctccacctggagacgctcatccagcagggtctgttctctctgctggagaaagccaccctggctgcaaggttcagcggcggccgccggggcagcacgcaccggattgcaacatgcgatgctttaaacctggtctgccgccagctcttcagatgcacagagggctacaaacaaccacaattagctttcagcacaacagccaccgtctgcgttaatgcgagatgaaccgcagtctttcacagagagagctgcgtgggaatgcgcttcagaaacgttgctggtaccagaagtcagcagtgttttcggtgatcagcagagcagaggtgtgagccgggcctaggcacgctcgctgaggacgcgctcatggcgcctgtgctgcctgcgggcagggccctcggctttggcaggagggaggacatctgtcctacgggtcatcaacctcaacttcagaaagtaacccataataatctccagaattttacaggacaaagatgcaaggtcaaaacaataaacctgcagactggggtcagagtccttgacttttgatggtgctgatttggttgggggcagcttgaggtcccccagccagagctggctcagtggtgggagcctgtggccgcgagggcagggggaggagtgcggagacaccactgctgctccgtgccctcagtggggctgtagggctgggcctgggcccctgtactctcctggatcctggggagaggccagggtccctgggatggggctgcctg

SEQ ID NO: 288004 - DNA, 745 bp, Homo sapiens
ctgtgtgaggcagactcagctcccaagcctgtctcaggcagcaggcagcccccgtgtgctggccatcccagctagcaggctggggtcctagagaatcgctaacctccaggaaaacagcctcctgtcgcctccacctggagacgctcatccagcagggtctgttctctctgctggagaaagccaccctggctgcaaggttcagcggcggccgccggggcagcacgcaccggattgcaacatgcgatgctttaaacctggtctgccgccagctcttcagatgcacagagggctacaaacaaccacaattagctttcagcacaacagccaccgtctgcgttaatgcgagatgaaccgcagtctttcacagagagagctgcgtgggaatgcgcttcagaaacgttgctggtaccagaagtcagcagtgttttcggtgatcagcagagcagagggcctccctgctccccacacagtctctgtgaccggggccgcctgcagcccggatcccttccgcaaggagctccctccgctgtctgcggcaacagacaccgccccctccagggctgctccctgcccctccaccccgggtgcagctgggagagcaaacaacaaggaaccgccactcccgctccttgcggatctgactctccaggtcgtgctcttctgggatcttcaacaacagaaaacacccagttaagcccagcgatgaaacagggttgtatcttggtatcaatggggtatgggttct

SEQ ID NO: 288005 - DNA, 992 bp, Homo sapiens
gtggggagattttgggtgacagccaatttataaatggatcgattcactcgggaatattttcatcatatggtgactgtgggatcttggagactgaatgcacatattacgagaatccccatgtgataacttgtgtttctcctctttgcagccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatctttctaaggaccttcaagtcatgactccagggaagcctattgggaagtctactaaaaactgcctgatttacaagaaagacctgaacttgtgggctcccatttgatttttttctcctcaggggactcagacattagaaagaaaaagcctcacagatttgaagaactggacccccaaatcaactcacctgcctggaagcaactgggaaacccttccaataagtcctgataataaagcacttcagggtcccatgtcttgatttttggcttgatagaaatactttgtcctttatttagtgtgatggggagggcttggactctgaaatcagttctgggttcaaattgtgaccagctgtgatttcaactgtctgaggctcggagattttaaacctggaaagtagatccccatctcggagggtggccatggaagttcatggagatgatgtacagggaatgcagtatctaactccagaaagtcctcggtttgagttaatggttatcatcaacacagtcactcttggttaactcaagagtcaaggtatgactcttgactaattccgtcattagggaggagttttctgttgtagtaagttaagtaaacttaaagaagatagtttattcctctcccatccaacagtcatattataagcagaccagagctgataaagc

SEQ ID NO: 288006 - DNA, 3177 bp, Homo sapiens
agcgggggacgttctggaaggtagcgtggggtagaaggcctgttgtggagggaaaccacccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccaggtgccttgccagatggccagaaccacacctcttgaagagtgacagtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccgggggtctttgtgttggtatttatgccaccaactctgccgaggcttgtcaatatgtcatcactcatgccaaagtgaacatcttgctggttgagaatgatcaacagttacagaaaatcctttcgattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacatcacgtggattgcaggagcagtgacaaaggactttaaactgacagacaagcatgagacggtggttagctacctcccactcagccatattgcagcacagatgatggacatctgggtacccataaagattggggcgctcacatactttgctcaagcagatgctctcaagggcaccttggtaagtactctaaaggaggtaaaacctactgtcttcattggagtgcctcaaatttgggagaagatacatgagatggtgaagaaaaatagtgccaagtccatgggcttgaagaagaaggcattcgtgtgggcaagaaacattggcttcaaggtcaactcaaaaaagatgttggggaaatataatactcccgtgagctaccgcatggctaagactctcgtgttcagcaaagtcaagacatcccttggcttggatcactgtcactcttttatcagtgggactgcgcccctcaaccaagagactgccgagttctttctaagcttggacatacctataggcgagttgtatgggttgagtgagagctcgggaccccacacgatatccaaccagaataactacaggcttctaagctgtggcaagatcttgactgggtgtaagaatatgctgttccagcagaacaaggatggcattggggagatctgcctctggggtaggcacatcttcatgggctatctggaaagtgagactgaaactacagaggccatcgatgatgaaggctggctacactctggggatctgggccagctggacggtctgggtttcctctatgtcaccggccacatcaaagaaatccttatcactgctggtggtgaaaatgtgccccccattcctgttgagaccttggttaagaagaagatccccatcatcagtaacgccatgttagtaggagataaactgaagtttctgagcatgttgctgacgctgaagtgtgagatgaatcagatgagcggagaacctctggacaagctgaacttcgaggccatcaacttctgtcggggtctgggcagccaggcatccaccgtgactgagattgtgaagcagcaagaccccctggtctacaaggccatccagcaaggcatcaatgctgtgaaccaggaagccatgaacaatgcacagaggattgaaaagtgggtcatcttggagaaggacttttccatctatggtggagagctaggtccaatgatgaaacttaagagacattttgtagcccagaaatacaaaaaacaaattgatcacatgtaccactgactgctttgatggagctgctctcagctgttctgatgccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatctttctaaggaccttcaagtcatgactccagggaagcctattgggaagtctactaaaaactgcctgatttacaagaaagacctgaacttgtgggctcccatttgatttttttctcctcaggggactcagacattagaaagaaaaagcctcacagatttgaagaactggacccccaaatcaactcacctgcctggaagcaactgggaaacccttccaataagtcctgataataaagcacttcagggtcccatgtcttgatttttggcttgatagaaatactttgtcctttatttagtgtgatggggagggcttggactctgaaatcagttctgggttcaaattgtgaccagctgtgatttcaactgtctgaggctcggagattttaaacctggaaagtagatccccatctcggagggtggccatggaagttcatggagatgatgtacagggaatgcagtatctaactccagaaagtcctcggtttgagttaatggttatcatcaacacagtcactcttggttaactcaagagtcaaggtatgactcttgactaattccgtcattagggaggagttttctgttgtagtaagttaagtaaacttaaagaagatagtttattcctctcccatccaacagtcatattataagcagaccagagctgataaagc

SEQ ID NO: 288007 - DNA, 3019 bp, Homo sapiens
agcggatggaacgttctggaaggaagaagaaaacacctgagtgaccagatgtcccagctccaggtgccttgccagatggccagaaccacacctcttgaagagtgacagtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccgggggtctttgtgttggtatttatgccaccaactctgccgaggcttgtcaatatgtcatcactcatgccaaagtgaacatcttgctggttgagaatgatcaacagttacagaaaatcctttcgattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacatcacgtggattgcaggagcagtgacaaaggactttaaactgacagacaagcatgagacggtggttagctacctcccactcagccatattgcagcacagatgatggacatctgggtacccataaagattggggcgctcacatactttgctcaagcagatgctctcaagggcaccttggtaagtactctaaaggaggtaaaacctactgtcttcattggagtgcctcaaatttgggagaagatacatgagatggtgaagaaaaatagtgccaagtccatgggcttgaagaagaaggcattcgtgtgggcaagaaacattggcttcaaggtcaactcaaaaaagatgttggggaaatataatactcccgtgagctaccgcatggctaagactctcgtgttcagcaaagtcaagacatcccttggcttggatcactgtcactcttttatcagtgggactgcgcccctcaaccaagagactgccgagttctttctaagcttggacatacctataggcgagttgtatgggttgagtgagagctcgggaccccacacgatatccaaccagaataactacaggcttctaagctgtggcaagatcttgactgggtgtaagaatatgctgttccagcagaacaaggatggcattggggagatctgcctctggggtaggcacatcttcatgggctatctggaaagtgagactgaaactacagaggccatcgatgatgaaggctggctacactctggggatctgggccagctggacggtctgggtttcctctatgtcaccggccacatcaaagaaatccttatcactgctggtggtgaaaatgtgccccccattcctgttgagaccttggttaagaagaagatccccatcatcagtaacgccatgttagtaggagataaactgaagtttctgagcatgttgctgacgctgaagtgtgagatgaatcagatgagcggagaacctctggacaagctgaacttcgaggccatcaacttctgtcggggtctgggcagccaggcatccaccgtgactgagattgtgaagcagcaagaccccctggtctacaaggccatccagcaaggcatcaatgctgtgaaccaggaagccatgaacaatgcacagaggattgaaaagtgggtcatcttggagaaggacttttccatctatggtggagagctaggtccaatgatgaaacttaagagacattttgtagcccagaaatacaaaaaacaaattgatcacatgtaccactgactgctttgatggagctgctctcagctgttctgatgccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatctttctaaggaccttcaagtcatgactccagggaagcctattgggaagtctactaaaaactgcctgatttacaagaaagacctgaacttgtgggctcccatttgatttttttctcctcaggggactcagacattagaaagaaaaagcctcacagatttgaagaactggacccccaaatcaactcacctgcctggaagcaactgggaaacccttccaataagtcctgataataaagcacttcagggtcccatgtcttgatttttggcttgatagaaatactttgtcctttatttagtgtgatggggagggcttggactctgaaatcagttctgggttcaaattgtgaccagctgtgatttcaactgtctgaggctcggagattttaaacctggaaagtagatccccatctcggagggtggccatggaagttcatggagatgatgtacagggaatgcagtatctaactccagaaagtcctcggtttgagttaatggttatcatcaacacagtcactcttggttaactcaagagtcaaggtatgactcttgactaattccgtcattagggaggagttttctgttgtagtaagttaagtaaacttaaagaagatagtttattcctctcccatccaacagtcatattataagcagaccagagctgataaagc

SEQ ID NO: 288008 - DNA, 2634 bp, Homo sapiens
agcgggggacgttctggaaggtagcgtggggtagaaggcctgttgtggagggaaaccacccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccaggtgccttgccagatggccagaaccacacctcttgaagagtgacagtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccggattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacatcacgtggattgcaggagcagtgacaaaggactttaaactgacagacaagcatgagacggtggttagctacctcccactcagccatattgcagcacagatgatggacatctgggtacccataaagattggggcgctcacatactttgctcaagcagatgctctcaagggcaccttggtaagtactctaaaggaggtaaaacctactgtcttcattggagtgcctcaaatttgggagaagatacatgagatggtgaagaaaaatagtgccaagtccatgggcttgaagaagaaggcattcgtgtgggcaagaaacattggcttcaaggtcaactcaaaaaagatgttggggaaatataatactcccgtgagctaccgcatggctaagactctcgtgttcagcaaagtcaagacatcccttggcttggatcactgtcactcttttatcagtgggactgcgcccctcaaccaagagactgccgagttctttctaagcttggacatacctataggcgagttgtatgggttgagtgagagctcgggaccccacacgatatccaaccagaataactacaggcttctaagctgtggcaagatcttgactgggtgtaagaatatgctgttccagcagaacaaggatggcattggggagatctgcctctggggtaggcacatcttcatgggctatctggaaagtgagactgaaactacagaggccatcgatgatgaaggctggctacactctggggatctgggccagctggacggtctgggtttcctctatgtcaccggccacatcaaagaaatccttatcactgctggtggtgaaaatgtgccccccattcctgttgagaccttggttaagaagaagatccccatcatcagtaacgccatgttagtaggagataaactgaagtttctgagcatgttgctgacgctgaagtgtgagatgaatcagatgagcggagaacctctggacaagctgaacttcgaggccatcaacttctgtcggggtctgggcagccaggcatccaccgtgactgagattgtgaagcagcaagaccccctggtctacaaggccatccagcaaggcatcaatgctgtgaaccaggaagccatgaacaatgcacagaggattgaaaagtgggtcatcttggagaaggacttttccatctatggtggagagctaggtccaatgatgaaacttaagagacattttgtagcccagaaatacaaaaaacaaattgatcacatgtaccactgactgctttgatggagctgctctcagctgttctgatgccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatctttctaaggaccttcaagtcatgactccagggaagcctattgggaagtctactaaaaactgcctgatttacaagaaagacctgaacttgtgggctcccatttgatttttttctcctcaggggactcagacattagaaagaaaaagcctcacagatttgaagaactggacccccaaatcaactcacctgcctggaagcaactgggaaacccttccaataagtcctgataataaagcacttcaggg

SEQ ID NO: 288009 - DNA, 2622 bp, Homo sapiens
agcggggtgaaaggatgccatcgcaatcctcctggctcccgatcgaacagcacatcgatccgtgactggacggatgaaggcgatgcatcgcgcgtggacatgttgaactgtgccaccttcttgtacaggttactcacgaagcaggctacctgttgactgtctttgcaggaagaagaaaacacctgagtgaccagatgtcccagctccaggtgccttgccagatggccagaaccacacctcttgaagagtgacagtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccggattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacatcacgtggattgcaggagcagtgacaaaggactttaaactgacagacaagcatgagacggtggttagctacctcccactcagccatattgcagcacagatgatggacatctgggtacccataaagattggggcgctcacatactttgctcaagcagatgctctcaagggcaccttggtaagtactctaaaggaggtaaaacctactgtcttcattggagtgcctcaaatttgggagaagatacatgagatggtgaagaaaaatagtgccaagtccatgggcttgaagaagaaggcattcgtgtgggcaagaaacattggcttcaaggtcaactcaaaaaagatgttggggaaatataatactcccgtgagctaccgcatggctaagactctcgtgttcagcaaagtcaagacatcccttggcttggatcactgtcactcttttatcagtgggactgcgcccctcaaccaagagactgccgagttctttctaagcttggacatacctataggcgagttgtatgggttgagtgagagctcgggaccccacacgatatccaaccagaataactacaggcttctaagctgtggcaagatcttgactgggtgtaagaatatgctgttccagcagaacaaggatggcattggggagatctgcctctggggtaggcacatcttcatgggctatctggaaagtgagactgaaactacagaggccatcgatgatgaaggctggctacactctggggatctgggccagctggacggtctgggtttcctctatgtcaccggccacatcaaagaaatccttatcactgctggtggtgaaaatgtgccccccattcctgttgagaccttggttaagaagaagatccccatcatcagtaacgccatgttagtaggagataaactgaagtttctgagcatgttgctgacgctgaagtgtgagatgaatcagatgagcggagaacctctggacaagctgaacttcgaggccatcaacttctgtcggggtctgggcagccaggcatccaccgtgactgagattgtgaagcagcaagaccccctggtctacaaggccatccagcaaggcatcaatgctgtgaaccaggaagccatgaacaatgcacagaggattgaaaagtgggtcatcttggagaaggacttttccatctatggtggagagctaggtccaatgatgaaacttaagagacattttgtagcccagaaatacaaaaaacaaattgatcacatgtaccactgactgctttgatggagctgctctcagctgttctgatgccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatctttctaaggaccttcaagtcatgactccagggaagcctattgggaagtctactaaaaactgcctgatttacaagaaagacctgaacttgtgggctcccatttgatttttttctcctcaggggactcagacattagaaagaaaaagcctcacagatttgaagaactggacccccaaatcaactcacctgcctggaagcaactgggaaacccttccaataagtcctgataataaagcacttcaggg

SEQ ID NO: 288010 - DNA, 3132 bp, Homo sapiens
agcgggggacgttctggaaggtagcgtggggtagaaggcctgttgtggagggaaaccacccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccagtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccgggggtctttgtgttggtatttatgccaccaactctgccgaggcttgtcaatatgtcatcactcatgccaaagtgaacatcttgctggttgagaatgatcaacagttacagaaaatcctttcgattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacatcacgtggattgcaggagcagtgacaaaggactttaaactgacagacaagcatgagacggtggttagctacctcccactcagccatattgcagcacagatgatggacatctgggtacccataaagattggggcgctcacatactttgctcaagcagatgctctcaagggcaccttggtaagtactctaaaggaggtaaaacctactgtcttcattggagtgcctcaaatttgggagaagatacatgagatggtgaagaaaaatagtgccaagtccatgggcttgaagaagaaggcattcgtgtgggcaagaaacattggcttcaaggtcaactcaaaaaagatgttggggaaatataatactcccgtgagctaccgcatggctaagactctcgtgttcagcaaagtcaagacatcccttggcttggatcactgtcactcttttatcagtgggactgcgcccctcaaccaagagactgccgagttctttctaagcttggacatacctataggcgagttgtatgggttgagtgagagctcgggaccccacacgatatccaaccagaataactacaggcttctaagctgtggcaagatcttgactgggtgtaagaatatgctgttccagcagaacaaggatggcattggggagatctgcctctggggtaggcacatcttcatgggctatctggaaagtgagactgaaactacagaggccatcgatgatgaaggctggctacactctggggatctgggccagctggacggtctgggtttcctctatgtcaccggccacatcaaagaaatccttatcactgctggtggtgaaaatgtgccccccattcctgttgagaccttggttaagaagaagatccccatcatcagtaacgccatgttagtaggagataaactgaagtttctgagcatgttgctgacgctgaagtgtgagatgaatcagatgagcggagaacctctggacaagctgaacttcgaggccatcaacttctgtcggggtctgggcagccaggcatccaccgtgactgagattgtgaagcagcaagaccccctggtctacaaggccatccagcaaggcatcaatgctgtgaaccaggaagccatgaacaatgcacagaggattgaaaagtgggtcatcttggagaaggacttttccatctatggtggagagctaggtccaatgatgaaacttaagagacattttgtagcccagaaatacaaaaaacaaattgatcacatgtaccactgactgctttgatggagctgctctcagctgttctgatgccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatctttctaaggaccttcaagtcatgactccagggaagcctattgggaagtctactaaaaactgcctgatttacaagaaagacctgaacttgtgggctcccatttgatttttttctcctcaggggactcagacattagaaagaaaaagcctcacagatttgaagaactggacccccaaatcaactcacctgcctggaagcaactgggaaacccttccaataagtcctgataataaagcacttcagggtcccatgtcttgatttttggcttgatagaaatactttgtcctttatttagtgtgatggggagggcttggactctgaaatcagttctgggttcaaattgtgaccagctgtgatttcaactgtctgaggctcggagattttaaacctggaaagtagatccccatctcggagggtggccatggaagttcatggagatgatgtacagggaatgcagtatctaactccagaaagtcctcggtttgagttaatggttatcatcaacacagtcactcttggttaactcaagagtcaaggtatgactcttgactaattccgtcattagggaggagttttctgttgtagtaagttaagtaaacttaaagaagatagtttattcctctcccatccaacagtcatattataagcagaccagagctgataaagc

SEQ ID NO: 288011 - DNA, 2948 bp, Homo sapiens
agcgggggacgttctggaaggtagcgtggggtagaaggcctgttgtggagggaaaccacccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccaggtgccttgccagatggccagaaccacacctcttgaagagtgacagtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccgggggtctttgtgttggtatttatgccaccaactctgccgaggcttgtcaatatgtcatcactcatgccaaagtgaacatcttgctggttgagaatgatcaacagttacagaaaatcctttcgattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacatcacgtggattgcaggagcagtgacaaaggactttaaactgacagacaagcatgagacggtggttagctacctcccactcagccatattgcagcacagatgatggacatctgggtacccataaagattggggcgctcacatactttgctcaagcagatgctctcaagggcaccttggtaagtactctaaaggaggtaaaacctactgtcttcattggagtgcctcaaatttgggagaagatacatgagatggtgaagaaaaatagtgccaagtccatgggcttgaagaagaaggcattcgtgtgggcaagaaacattggcttcaaggtcaactcaaaaaagatgttggggaaatataatactcccgtgagctaccgcatggctaagactctcgtgttcagcaaagtcaagacatcccttggcttggatcactgtcactcttttatcagtgggactgcgcccctcaaccaagagactgccgagttctttctaagcttggacatacctataggcgagttgtatgggttgagtgagagctcgggaccccacacgatatccaaccagaataactacaggcttctaagctgtggcaagatcttgactgggtgtaagaatatgctgttccagcagaacaaggatggcattggggagatctgcctctggggtaggcacatcttcatgggctatctggaaagtgagactgaaactacagaggccatcgatgatgaaggctggctacactctggggatctgggccagctggacggtctgggtttcctctatgtcaccggccacatcaaagaaatccttatcactgctggtggtgaaaatgtgccccccattcctgttgagaccttggttaagaagaagatccccatcatcagtaacgccatgttagtaggagataaactgaagtttctgagcatgttgctgacgctgaagtgtgagatgaatcagatgagcggagaacctctggacaagctgaacttcgaggccatcaacttctgtcggggtctgggcagccaggcatccaccgtgactgagattgtgaagcagcaagaccccctggtctacaaggccatccagcaaggcatcaatgctgtgaaccaggaagccatgaacaatgcacagaggattgaaaagtgggtcatcttggagaaggacttttccatctatggtggagagctaggtccaatgatgaaacttaagagacattttgtagcccagaaatacaaaaaacaaattgatcacatgtaccactgactgctttgatggagctgctctcagctgttctgatggtgagattcagttgcttggctttgctgggctatgcattcagagtccaagagagggctccactgtgtggcaggcagatctgtgactggaactgcagaaaacacacacatacacacatacatacacacacacacacacacacacacacacacacacacacactcttagttgcagtggattctgagtagcaggcttcaactcatgctgtctctactctaccagggtcatggtagggtgtgtaaactccttcagctggccaccaatgttgttagctgtgcttcctgccttttctatttgtttctagaaagtaggaggcaatgaatcccaaatgtctcattgggtcttatttggagaaggcctttgtcagaaactttagtggagaaagttctacttgccaggaactcaaggaatgaggtgtgttggcccattacacagataataagggatggaggcttgaacttccactatccaccgtttatcctctcttttccccaagacatgtgcagagggagcctccatgacaccatgaatcactgatagttattgaggtgttttttttttttttcttcactagatgcacagtgcaggcagaaagtagaatgcatcttcaattgtcc

SEQ ID NO: 288012 - DNA, 3011 bp, Homo sapiens
agcgggggacgttctggaaggtagcgtggggtagaaggcctgttgtggagggaaaccacccatcctcctgcctcccaccaccaccatcatcctggctggacggagagggtgacgggggctgggaaggggcagctcatgttcaggtttccaggaggggctacctgttgactgtctttgcaggaagaagaaaacacctgagtgaccagatgtcccagctccagtgctgtggagcatggtttctgcacacctggaatgactggaaccccaaagactcaagaaggagctaaagatcttgaagtagacatgaataaaacagaagttactcccaggctgtggaccacctgtcgagatggagaagtccttctgaggctatccaaacacggaccaggccatgagaccccgatgaccatccctgaattttttcgagagtcagtcaaccgatttggaacttatccagccctcgcatccaagaatggcaaaaagtgggaaattctgaatttcaaccagtactatgaggcttgtcggaaggctgcaaaatccttgatcaagctgggtttggagcgtttccacggagttggtatcctggggtttaactctgcagagtggtttatcactgctgttggtgccatcctagccggattccacagagcagcctagagcccctaaaagcgatcatccagtacagactgccaatgaagaagaacaacaacttgtactcttgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacatcacgtggattgcaggagcagtgacaaaggactttaaactgacagacaagcatgagacggtggttagctacctcccactcagccatattgcagcacagatgatggacatctgggtacccataaagattggggcgctcacatactttgctcaagcagatgctctcaagggcaccttggtaagtactctaaaggaggtaaaacctactgtcttcattggagtgcctcaaatttgggagaagatacatgagatggtgaagaaaaatagtgccaagtccatgggcttgaagaagaaggcattcgtgtgggcaagaaacattggcttcaaggtcaactcaaaaaagatgttggggaaatataatactcccgtgagctaccgcatggctaagactctcgtgttcagcaaagtcaagacatcccttggcttggatcactgtcactcttttatcagtgggactgcgcccctcaaccaagagactgccgagttctttctaagcttggacatacctataggcgagttgtatgggttgagtgagagctcgggaccccacacgatatccaaccagaataactacaggcttctaagctgtggcaagatcttgactgggtgtaagaatatgctgttccagcagaacaaggatggcattggggagatctgcctctggggtaggcacatcttcatgggctatctggaaagtgagactgaaactacagaggccatcgatgatgaaggctggctacactctggggatctgggccagctggacggtctgggtttcctctatgtcaccggccacatcaaagaaatccttatcactgctggtggtgaaaatgtgccccccattcctgttgagaccttggttaagaagaagatccccatcatcagtaacgccatgttagtaggagataaactgaagtttctgagcatgttgctgacgctgaagtgtgagatgaatcagatgagcggagaacctctggacaagctgaacttcgaggccatcaacttctgtcggggtctgggcagccaggcatccaccgtgactgagattgtgaagcagcaagaccccctggtctacaaggccatccagcaaggcatcaatgctgtgaaccaggaagccatgaacaatgcacagaggattgaaaagtgggtcatcttggagaaggacttttccatctatggtggagagctaggtccaatgatgaaacttaagagacattttgtagcccagaaatacaaaaaacaaattgatcacatgtaccactgactgctttgatggagctgctctcagctgttctgatgccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatctttctaaggaccttcaagtcatgactccagggaagcctattgggaagtctactaaaaactgcctgatttacaagaaagacctgaacttgtgggctcccatttgatttttttctcctcaggggactcagacattagaaagaaaaagcctcacagatttgaagaactggacccccaaatcaactcacctgcctggaagcaactgggaaacccttccaataagtcctgataataaagcacttcagggtcccatgtcttgatttttggcttgatagaaatactttgtcctttatttagtgtgatggggagggcttggactctgaaatcagttctgggttcaaattgtgaccagctgtgatttcaactgtctgaggctcggagattttaaacctggaaagtagatccccatctcggagggtggccatggaagttcatggagatgatgtacagggaatgcagtatctaactccagaaagtcctcggtttgagttaatggttatcatcaacacagtcactcttggttaactcaagagtcaaggtatgactcttgactaattccgtcattagggaggagttttctgttgtagtaagttaagtaaacttaaagaagatagtttattcctctcccatccaacagtcatattataagcagaccagagctgataaagc

SEQ ID NO: 288013 - DNA, 635 bp, Homo sapiens
taatcaaaaagggaatgtgataatctacaggtcacatttggcagtttagtttaaaagtaaacaggctttccaattaacccaccttgggaaggtcttgtgattcatggtgaaatcttgtccctgaatcttatcatgagtctctcaaattgttgacacagtgattaatgcataacccagtgaccctgaaaaggacactgatttatttctggatcttagagttttactgattgtcttgcatggatacatttgagcctgcatgttgcgatctgtatccaatgattgtaacttctgtattgtatccttcaatgagaaaggacagctctggtgtgaggagtccctctcccttctcctaaactcttctacaaaacaggggtttccaacttccgggataaggacctgtaccaacccatggcctgttaggaaatgggccacacagcagaagctctccaggaacacatctttgaagacaaaatgcctccaagatccccagtactgtagctcttctcctgaaggtctagtgttggcttttcttcctgagaaagttgaaaaacaacataaatgtctctttacattgcaaatagtagtgttttacaaaaccaccattcaaatgcaacttttcaggatcctgtctagaa

SEQ ID NO: 288014 - DNA, 3808 bp, Homo sapiens
ggcctgggccggaggggcggggtgagaaggctgcgcgcgggtaaaggggccgcctcgagcgcggtccgagcgttcagcggacgcgcgcggcctcgatctctggactcgtcacctgcccctccccctcccgccgccgtcacccaggaaaccggccgcaatcgccggccgacctgaagctggtttcatggcagcctcaaagaaggcagttttggggccattggtgggggcggtggaccagggcaccagttcgacgcgctttttggttttcaattcaaaaacagctgaactacttagtcatcatcaagtagaaataaaacaagagttcccaagagaaggatgggtggaacaggaccctaaggaaattctacattctgtctatgagtgtatagagaaaacatgtgagaaacttggacagctcaatattgatatttccaacataaaagctattggtgtcagcaaccagagggaaaccactgtagtctgggacaagataactggagagcctctctacaatgctgtggtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggagtttgacaggaggagtcaatggaggtgtccactgtacagatgtaacaaatgcaagtaggactatgcttttcaacattcattctttggaatgggataaacaactctgcgaattttttggaattccaatggaaattcttccaaatgtccggagttcttctgagatctatggcctaatgaaagctggggccttggaaggtgtgccaatatctgggtgtttaggggaccagtctgctgcattggtgggacaaatgtgcttccagattggacaagccaaaaatacgtatggaacaggatgtttcttactatgtaatacaggccataagtgtgtattttctgatcatggccttctcaccacagtggcttacaaacttggcagagacaaaccagtatattatgctttggaaggttctgtagctatagctggtgctgttattcgctggctaagagacaatcttggaattataaagacctcagaagaaattgaaaaacttgctaaagaagtaggtacttcttatggctgctacttcgtcccagcattttcggggttatatgcaccttattgggagcccagcgcaagagggataatctgtggactcactcagttcaccaataaatgccatattgcttttgctgcattagaagctgtttgtttccaaactcgagagattttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggaggaaagtgaaattcgttattctacatggaagaaagctgtgatgaagtcaatgggttgggttacaactcaatctccagaaagtggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatcagcagctctttgcttttaacagacaccctaaaagtcttcttttctacatagttgaagacagcaacatcttcactgaatgtttgaatagaaacctctactaaattattaaaatagacatttagtgttctcacagcttggatatttttctgaaaagttatttgccaaaactgaaatccttcagatgttttccatggtcccactaattataatgactttctgtctggatcttataggaaaagatactttcttttttcttccatctttcctttttatattttttactttgtatgtataacatacatgcctatatattttatacactgagggtagcccatttataaattaagagcacattatattcagaaggttctaacagggctggtcttaagtgaaccactgtgtatataaatatgttggaaaacagctgtatacatttttgggcaacggttatgcataatatttaccaggagaatttttttcttaacaagccaacatttaaaatttatgttttatgtcaataaaagaaaatatactttattgtgacttcaactatatttcttatcccttacatttttatttaattgtcttagcttaaaaaaagaagaaactgtggaatactacagtaaatattgttttcaaacacaagcaataattcaaatagttatttttcttttgaattaattttagacatattttggatcctattgaggggataagaggatgtcaaaaaagttaaatacctaagtagaaaaaaatatagaaataaagccaagaatctctttcagttcaaatgttatcaattgttaataagaaattgctatctgggatgacagaattacctctgcttagtatctcattataactgaaagaaggtttatcattacaaataccttccaatgaaaccaagaatttctcaaaatatttaatgtcacatattataagaagttacctaatcctgcttcttaacatcaatttttaaaaatatcttaaaattactttgttttgtagtaaacagtgaagaaaagattgcctcctaattatttttttcaatgagtgctgaatgggaaaacatttatatcttactataaaaggttctgttttgtttggaatcaatggtagctttattgactgttctgattgtgctgtttctaatttattgaatctgctaggttttattgatgcagccaccacttaagtgacataaatattatagaaaggtactgtgaaatgatcactttgtggcaggggtacttttaaacataaatgtttctacaaaagtaggttgagttcattgtaaataattgtgaaagccactgttcaaataattttaagattacattaatttttctataaattggaagatttataaatgtttgaaattgtacacattgatatttaatgacaaatttacttaaaataaattgaccccttgttcttacttgcatttctcatttacagactagaacttagttgaaagttaaattaagaaagatgtttcagaggccgggcacggtggctgacgcctgtaatcccagcactttgggaggccgaggtgggcagatcacctgaggtcaggagttcgggactagcctaaccgacatggagaaaccctatctctact

SEQ ID NO: 288015 - DNA, 3895 bp, Homo sapiens
ggcctgggccggaggggcggggtgagaaggctgcgcgcgggtaaaggggccgcctcgagcgcggtccgagcgttcagcggacgcgcgcggcctcgatctctggactcgtcacctgcccctccccctcccgccgccgtcacccaggaaaccggccgcaatcgccggccgacctgaagctggtttcatggcagcctcaaagaaggcagttttggggccattggtgggggcggtggaccagggcaccagttcgacgcgctttttggttttcaattcaaaaacagctgaactacttagtcatcatcaagtagaaataaaacaagagttcccaagagaaggatgggtggaacaggaccctaaggaaattctacattctgtctatgagtgtatagagaaaacatgtgagaaacttggacagctcaatattgatatttccaacataaaagctattggtgtcagcaaccagagggaaaccactgtagtctgggacaagataactggagagcctctctacaatgctgtggtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggagtttgacaggaggagtcaatggaggtgtccactgtacagatgtaacaaatgcaagtaggactatgcttttcaacattcattctttggaatgggataaacaactctgcgaattttttggaattccaatggaaattcttccaaatgtccggagttcttctgagatctatggcctaatgaaagctggggccttggaaggtgtgccaatatctgggtgtttaggggaccagtctgctgcattggtgggacaaatgtgcttccagattggacaagccaaaaatacgtatggaacaggatgtttcttactatgtaatacaggccataagtgtgtattttctgatcatggccttctcaccacagtggcttacaaacttggcagagacaaaccagtatattatgctttggaaggttctgtagctatagctggtgctgttattcgctggctaagagacaatcttggaattataaagacctcagaagaaattgaaaaacttgctaaagaagtaggtacttcttatggctgctacttcgtcccagcattttcggggttatatgcaccttattgggagcccagcgcaagagggataatctgtggactcactcagttcaccaataaatgccatattgcttttgctgcattagaagctgtttgtttccaaactcgagagattttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggaggaaagtgaaattcgttattctacatggaagaaagctgtgatgaagtcaatgggttgggttacaactcaatctccagaaagtggtgaccctagtatcttctgtagtctgcccttgggcttttttatagtgagtagcatggtaatgttaatcggagcaaggtacatctcaggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatcagcagctctttgcttttaacagacaccctaaaagtcttcttttctacatagttgaagacagcaacatcttcactgaatgtttgaatagaaacctctactaaattattaaaatagacatttagtgttctcacagcttggatatttttctgaaaagttatttgccaaaactgaaatccttcagatgttttccatggtcccactaattataatgactttctgtctggatcttataggaaaagatactttcttttttcttccatctttcctttttatattttttactttgtatgtataacatacatgcctatatattttatacactgagggtagcccatttataaattaagagcacattatattcagaaggttctaacagggctggtcttaagtgaaccactgtgtatataaatatgttggaaaacagctgtatacatttttgggcaacggttatgcataatatttaccaggagaatttttttcttaacaagccaacatttaaaatttatgttttatgtcaataaaagaaaatatactttattgtgacttcaactatatttcttatcccttacatttttatttaattgtcttagcttaaaaaaagaagaaactgtggaatactacagtaaatattgttttcaaacacaagcaataattcaaatagttatttttcttttgaattaattttagacatattttggatcctattgaggggataagaggatgtcaaaaaagttaaatacctaagtagaaaaaaatatagaaataaagccaagaatctctttcagttcaaatgttatcaattgttaataagaaattgctatctgggatgacagaattacctctgcttagtatctcattataactgaaagaaggtttatcattacaaataccttccaatgaaaccaagaatttctcaaaatatttaatgtcacatattataagaagttacctaatcctgcttcttaacatcaatttttaaaaatatcttaaaattactttgttttgtagtaaacagtgaagaaaagattgcctcctaattatttttttcaatgagtgctgaatgggaaaacatttatatcttactataaaaggttctgttttgtttggaatcaatggtagctttattgactgttctgattgtgctgtttctaatttattgaatctgctaggttttattgatgcagccaccacttaagtgacataaatattatagaaaggtactgtgaaatgatcactttgtggcaggggtacttttaaacataaatgtttctacaaaagtaggttgagttcattgtaaataattgtgaaagccactgttcaaataattttaagattacattaatttttctataaattggaagatttataaatgtttgaaattgtacacattgatatttaatgacaaatttacttaaaataaattgaccccttgttcttacttgcatttctcatttacagactagaacttagttgaaagttaaattaagaaagatgtttcagaggccgggcacggtggctgacgcctgtaatcccagcactttgggaggccgaggtgggcagatcacctgaggtcaggagttcgggactagcctaaccgacatggagaaaccctatctctact

SEQ ID NO: 288016 - DNA, 642 bp, Homo sapiens
ggcctgggccggaggggcggggtgagaaggctgcgcgcgggtaaaggggccgcctcgagcgcggtccgagcgttcagcggacgcgcgcggcctcgatctctggactcgtcacctgcccctccccctcccgccgccgtcacccaggaaaccggccgcaatcgccggccgacctgaagctggtttcatggcagcctcaaagaaggcagttttggggccattggtgggggcggtggaccagggcaccagttcgacgcgctttttggttttcaattcaaaaacagctgaactacttagtcatcatcaagtagaaataaaacaagagttcccaagagaaggatgggtggaacaggaccctaaggaaattctacattctgtctatgagtgtatagagaaaacatgtgagaaacttggacagctcaatattgatatttccaacataaaagctattggtgtcagcaaccagagggaaaccactgtagtctgggacaagataactggagagcctctctacaatgctgtggattgtcttacaaatgagtgaatgtttgccaaattgttttataacccctgctgtttgtgacatctaaaagagatcttacctccttaccctcaaaaaattaaaattacgtgtgttcacagtca

SEQ ID NO: 288017 - DNA, 3826 bp, Homo sapiens
ggcctgggccggaggggcggggtgagaaggctgcgcgcgggtaaaggggccgcctcgagcgcggtccgagcgttcagcggacgcgcgcggcctcgatctctggactcgtcacctgcccctccccctcccgccgccgtcacccaggaaaccggccgcaatcgccggccgacctgaagctggtttcatggcagcctcaaagaaggcagttttggggccattggtgggggcggtggaccagggcaccagttcgacgcgctttttggttttcaattcaaaaacagctgaactacttagtcatcatcaagtagaaataaaacaagagttcccaagagaaggatgggtggaacaggaccctaaggaaattctacattctgtctatgagtgtatagagaaaacatgtgagaaacttggacagctcaatattgatatttccaacataaaagctattggtgtcagcaaccagagggaaaccactgtagtctgggacaagataactggagagcctctctacaatgctgtggtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggagtttgacaggaggagtcaatggaggtgtccactgtacagatgtaacaaatgcaagtaggactatgcttttcaacattcattctttggaatgggataaacaactctgcgaattttttggaattccaatggaaattcttccaaatgtccggagttcttctgagatctatggcctaatgaaaatctctcatagcgtgaaagctggggccttggaaggtgtgccaatatctgggtgtttaggggaccagtctgctgcattggtgggacaaatgtgcttccagattggacaagccaaaaatacgtatggaacaggatgtttcttactatgtaatacaggccataagtgtgtattttctgatcatggccttctcaccacagtggcttacaaacttggcagagacaaaccagtatattatgctttggaaggttctgtagctatagctggtgctgttattcgctggctaagagacaatcttggaattataaagacctcagaagaaattgaaaaacttgctaaagaagtaggtacttcttatggctgctacttcgtcccagcattttcggggttatatgcaccttattgggagcccagcgcaagagggataatctgtggactcactcagttcaccaataaatgccatattgcttttgctgcattagaagctgtttgtttccaaactcgagagattttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggaggaaagtgaaattcgttattctacatggaagaaagctgtgatgaagtcaatgggttgggttacaactcaatctccagaaagtggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatcagcagctctttgcttttaacagacaccctaaaagtcttcttttctacatagttgaagacagcaacatcttcactgaatgtttgaatagaaacctctactaaattattaaaatagacatttagtgttctcacagcttggatatttttctgaaaagttatttgccaaaactgaaatccttcagatgttttccatggtcccactaattataatgactttctgtctggatcttataggaaaagatactttcttttttcttccatctttcctttttatattttttactttgtatgtataacatacatgcctatatattttatacactgagggtagcccatttataaattaagagcacattatattcagaaggttctaacagggctggtcttaagtgaaccactgtgtatataaatatgttggaaaacagctgtatacatttttgggcaacggttatgcataatatttaccaggagaatttttttcttaacaagccaacatttaaaatttatgttttatgtcaataaaagaaaatatactttattgtgacttcaactatatttcttatcccttacatttttatttaattgtcttagcttaaaaaaagaagaaactgtggaatactacagtaaatattgttttcaaacacaagcaataattcaaatagttatttttcttttgaattaattttagacatattttggatcctattgaggggataagaggatgtcaaaaaagttaaatacctaagtagaaaaaaatatagaaataaagccaagaatctctttcagttcaaatgttatcaattgttaataagaaattgctatctgggatgacagaattacctctgcttagtatctcattataactgaaagaaggtttatcattacaaataccttccaatgaaaccaagaatttctcaaaatatttaatgtcacatattataagaagttacctaatcctgcttcttaacatcaatttttaaaaatatcttaaaattactttgttttgtagtaaacagtgaagaaaagattgcctcctaattatttttttcaatgagtgctgaatgggaaaacatttatatcttactataaaaggttctgttttgtttggaatcaatggtagctttattgactgttctgattgtgctgtttctaatttattgaatctgctaggttttattgatgcagccaccacttaagtgacataaatattatagaaaggtactgtgaaatgatcactttgtggcaggggtacttttaaacataaatgtttctacaaaagtaggttgagttcattgtaaataattgtgaaagccactgttcaaataattttaagattacattaatttttctataaattggaagatttataaatgtttgaaattgtacacattgatatttaatgacaaatttacttaaaataaattgaccccttgttcttacttgcatttctcatttacagactagaacttagttgaaagttaaattaagaaagatgtttcagaggccgggcacggtggctgacgcctgtaatcccagcactttgggaggccgaggtgggcagatcacctgaggtcaggagttcgggactagcctaaccgacatggagaaaccctatctctact

SEQ ID NO: 288018 - DNA, 3449 bp, Homo sapiens
agcggagtgcaagggtagctaagttcaggtgctgtttgattccagactcagacagtatcacctgcatccccctcaagcctgccttttctgggatggctcctgatgtggcatattcaactcccacttcatgagggcagcaggcccaagccacacactgccaagtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggagtttgacaggaggagtcaatggaggtgtccactgtacagatgtaacaaatgcaagtaggactatgcttttcaacattcattctttggaatgggataaacaactctgcgaattttttggaattccaatggaaattcttccaaatgtccggagttcttctgagatctatggcctaatgaaagctggggccttggaaggtgtgccaatatctgggtgtttaggggaccagtctgctgcattggtgggacaaatgtgcttccagattggacaagccaaaaatacgtatggaacaggatgtttcttactatgtaatacaggccataagtgtgtattttctgatcatggccttctcaccacagtggcttacaaacttggcagagacaaaccagtatattatgctttggaaggttctgtagctatagctggtgctgttattcgctggctaagagacaatcttggaattataaagacctcagaagaaattgaaaaacttgctaaagaagtaggtacttcttatggctgctacttcgtcccagcattttcggggttatatgcaccttattgggagcccagcgcaagagggataatctgtggactcactcagttcaccaataaatgccatattgcttttgctgcattagaagctgtttgtttccaaactcgagagattttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggaggaaagtgaaattcgttattctacatggaagaaagctgtgatgaagtcaatgggttgggttacaactcaatctccagaaagtggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatcagcagctctttgcttttaacagacaccctaaaagtcttcttttctacatagttgaagacagcaacatcttcactgaatgtttgaatagaaacctctactaaattattaaaatagacatttagtgttctcacagcttggatatttttctgaaaagttatttgccaaaactgaaatccttcagatgttttccatggtcccactaattataatgactttctgtctggatcttataggaaaagatactttcttttttcttccatctttcctttttatattttttactttgtatgtataacatacatgcctatatattttatacactgagggtagcccatttataaattaagagcacattatattcagaaggttctaacagggctggtcttaagtgaaccactgtgtatataaatatgttggaaaacagctgtatacatttttgggcaacggttatgcataatatttaccaggagaatttttttcttaacaagccaacatttaaaatttatgttttatgtcaataaaagaaaatatactttattgtgacttcaactatatttcttatcccttacatttttatttaattgtcttagcttaaaaaaagaagaaactgtggaatactacagtaaatattgttttcaaacacaagcaataattcaaatagttatttttcttttgaattaattttagacatattttggatcctattgaggggataagaggatgtcaaaaaagttaaatacctaagtagaaaaaaatatagaaataaagccaagaatctctttcagttcaaatgttatcaattgttaataagaaattgctatctgggatgacagaattacctctgcttagtatctcattataactgaaagaaggtttatcattacaaataccttccaatgaaaccaagaatttctcaaaatatttaatgtcacatattataagaagttacctaatcctgcttcttaacatcaatttttaaaaatatcttaaaattactttgttttgtagtaaacagtgaagaaaagattgcctcctaattatttttttcaatgagtgctgaatgggaaaacatttatatcttactataaaaggttctgttttgtttggaatcaatggtagctttattgactgttctgattgtgctgtttctaatttattgaatctgctaggttttattgatgcagccaccacttaagtgacataaatattatagaaaggtactgtgaaatgatcactttgtggcaggggtacttttaaacataaatgtttctacaaaagtaggttgagttcattgtaaataattgtgaaagccactgttcaaataattttaagattacattaatttttctataaattggaagatttataaatgtttgaaattgtacacattgatatttaatgacaaatttacttaaaataaattgaccccttgttcttacttgcatttctcatttacagactagaacttagttgaaagttaaattaagaaagatgtttcagaggccgggcacggtggctgacgcctgtaatcccagcactttgggaggccgaggtgggcagatcacctgaggtcaggagttcgggactagcctaaccgacatggagaaaccctatctctact

SEQ ID NO: 288019 - DNA, 1857 bp, Homo sapiens
ggcctgggccggaggggcggggtgagaaggctgcgcgcgggtaaaggggccgcctcgagcgcggtccgagcgttcagcggacgcgcgcggcctcgatctctggactcgtcacctgcccctccccctcccgccgccgtcacccaggaaaccggccgcaatcgccggccgacctgaagctggtttcatggcagcctcaaagaaggcagttttggggccattggtgggggcggtggaccagggcaccagttcgacgcgctttttggttttcaattcaaaaacagctgaactacttagtcatcatcaagtagaaataaaacaagagttcccaagagaaggatgggtggaacaggaccctaaggaaattctacattctgtctatgagtgtatagagaaaacatgtgagaaacttggacagctcaatattgatatttccaacataaaagctattggtgtcagcaaccagagggaaaccactgtagtctgggacaagataactggagagcctctctacaatgctgtggtgtggcttgatctaagaacccagtctaccgttgagagtcttagtaaaagaattccaggaaataataactttgtcaagtccaagacaggccttccacttagcacttacttcagtgcagtgaaacttcgttggctccttgacaatgtgagaaaagttcaaaaggccgttgaagaaaaacgagctctttttgggactattgattcatggcttatttggagtttgacaggaggagtcaatggaggtgtccactgtacagatgtaacaaatgcaagtaggactatgcttttcaacattcattctttggaatgggataaacaactctgcgaattttttggaattccaatggaaattcttccaaatgtccggagttcttctgagatctatggcctaatgaaagctggggccttggaaggtgtgccaatatctgggtgtttaggggaccagtctgctgcattggtgggacaaatgtgcttccagattggacaagccaaaaatacgtatggaacaggatgtttcttactatgtaatacaggccataagtgtgtattttctgatcatggccttctcaccacagtggcttacaaacttggcagagacaaaccagtatattatgctttggaaggttctgtagctatagctggtgctgttattcgctggctaagagacaatcttggaattataaagacctcagaagaaattgaaaaacttgctaaagaagtaggtacttcttatggctgctacttcgtcccagcattttcggggttatatgcaccttattgggagcccagcgcaagagggataatctgtggactcactcagttcaccaataaatgccatattgcttttgctgcattagaagctgtttgtttccaaactcgagagattttggatgccatgaatcgagactgtggaattccactcagtcatttgcaggtagatggaggaatgaccagcaacaaaattcttatgcagctacaagcagacattctgtatataccagtagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggagggtacatttaaagaatgaaatgttcagtgatatactgtgaaaacgaccttagtgcacgggagttttgtttttctgtttagttaaaagttaaggaaccaagtaaaatagtaaatgttatcattgcagattcggctgccaagcatattgggctttactgaataaatgtgaatgagagaaatcgttgcttatca

SEQ ID NO: 288020 - DNA, 432 bp, Homo sapiens
tggcacattgctacttgtgttcactcttgttgcagctatgttagtagagccaaaattttgtgactattcataatcctttttttaaattttattagaaagctggggccttggaaggtgtgccaatatctggggtaagtttcatcaccaagtgtctccccatccccacccttccccatgttatggctttcctcctcttagttcatcagtgtgcctctttttaaactagggaaaacaagtaaaagttgcaaaattggctaattcttgttcttacatgtcatactgtgggccattgagaatcttttgaataaattaattttaactctcccttcccatacctattatcttacatattaacaaatggtattaacaaatggggaaaatggccaaatggagaaaatgcaaggaaatagacagttcattctttgataaata

SEQ ID NO: 288021 - DNA, 854 bp, Homo sapiens
ggaatatattgcataatcttattaatttataatagccatttgtggaagctgctcctggtgatagctcaatttttcttaaaattactggcttaaatggaaatgatgcttcttattctgtatgttcccatgaaagtgaaacttaaaaaaaaattcatgattagggtttcatgaaaggccttgtttctatgaaaattgagacaggttgcatctctctaagctaaaagatgggctatgtgtctagagtcttagacttctaaaatgcatgtggtcactatatgtaggttatctcttcggtgacatacactgcaatttgagagggctggaaattgtttgccttggtaaacgattagcaacagtggcaatatttgttaattttggaattggccctgtttgttgcattttaattgtgaggcatgatttagaaatcatatggactttctagcttaataaatgattgaatcatctgcattgctttaactcctgaattgtatgcatgtattattgacatatatggtttttgttccccatttcaggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaa

SEQ ID NO: 288022 - DNA, 2666 bp, Homo sapiens
  misc_feature (92)..(92): n is a, c, g, or t
gctgaacccccacgaggcagagtccctggcgctggtgggcgccatgattgaccaggtcctggagctacacccaggcgcccagcggctgcacntcgggtgtgatgaggtctattacctcggagagggggaggcctcgcgccggtggctacagcaagagcagaacagcacggggaagttgtgcctgtcacacatgcgggcggtggccagcggcgtgaaggcccggcgccccagcgtgacacccctggtgtgggacgacatgctccgagacctgcctgaggaccagctcgcagcgtccggggtgccgcagctggtggagccggtgctctgggactacacggccgacctggatgtgcacggcaaggtcctcctcatgcagaagtaccggcggtgcggctttccgcagctgtgggcagccagtgccttcaagggtgccacggggcccagccaggccgtgccccctgttgagcaccacctcaggaaccacgtgcagtggctgcaggtggcgggcagcgggcccacggactcactgcagggcatcatcctgaccggctggcagaggtacgaccactactctgtgctgtgcgagctgctgcccgcaggagtcccgtccctggccgcctgcctgcagttgcttctacgcggtatgtctggtctggccaccccaagccccaccggcccctccccgaaagacccggagggcaggaggccaagcacccagtgctccaaccaccctgctggactgtggtggtcctcacagtcggaggatggtctcaccgccccagctcagccacccacctgccctgaagtccacccaggctgggcctgtgtctgggtctccaggcctaagcccaaagcaggctggagagtgacgcgggaggcacccctcagacacagtgaatccgcagaaatgcacgcaggtcggaggtggggaacggctccacctttgctgcacacacgtcctgcccacctggccgagcaggtgtggggctcaggcgcccggccctggaaggccccgcaccctggacccagcactcacacttccaggtctcctgagggagcagcgggacccatgggcaggggcaggcaccggggaacccttggggtcggcagggggcttggccagaggagctgtgtgtgtggaaactcgcaggccacacgggaaattagcgactgcgtggtgctgatgcagaaagaaaaatggccgagacgcgcggagaggtatcccgcaggcgcggcggcccagggacggggacgcggccggtgagaggacgcagaatgagatcagattgacttctcagttgctgactctcaactgcttagaaaggggcagaaacgataaaaacagacacccctgtaccccacactaaagagctgtgttaatattgacggtatttgcagtgtcccttgcccacggccccatccgccacccgtgactggggcacttccctcctgccctctggccgtcagcctcttgcagcaagcatttccatgaacaccaagtcggagattcgtccacgctggtgcctgcaggcctcatgggtttgtttcgggtgctctagaatattccatcgattgtgtaaaacacagtggcaaactctgcgtgagccctggacacctgtgtgggtcgggctgcgcccagcaggaagagccacttgctgtccgggtgttgctgctggcaacacagtcttacttctgttttctgatttttaaaataaggaacgtatttcacgtgtttaaagagaagcagcaggcccatttgcccccaggtccccttggggccggcacacgcggggctgggcctggccagtggctctccattgccgcccgcccactgccccagtacctaggcctgcaggtcccaatgtagccccctcccctcctccagaggcccctccaaccgccccgctcatttgtgatttcaggaggatttgatgaagatgttaaagcgaaagtggagaaccttctcgggatttccagcctggaaaaaacggaccctgttagggagggggccggctccttccctggcagcaacatccttgcccttgtcacacaagtcagcctccatctgcgcagctctgtggatgcgctgctggagggcaacaggtatgtcactggctggttcagcccctaccaccgccagcggaagctcatccacccggtcatggttcagcacatccagcccgcagcgctcagcctcctggcacagtggagcaccctcgtgcaggagctggaggctgccctgcagctggctttctacccggatgccgtggaggagtggctggaggaaaacgtgcaccccagcctgcagcggctgcaagctctgctgcaggacctcagcgaggtgtctgcccccccgctgccacccaccagccctggcagggacgttgctcaggacccctgaggggagagctcatgccagggggctcctgctggaggctgggggggctctgcactgccaaatggcctgggcaatacgggcccacgtgggcgtcgtgccctctggcccagcagtgtcttgcccacactcagttcctgagggccctgggcagcccctgggggagagactagaaaacacagaaggaagcagcacagggagacccgctttgtgatctgcatgtgtgacactgattctttggaaataaagagtggaagctgcaggtgacacg

SEQ ID NO: 288023 - DNA, 1385 bp, Homo sapiens
  misc_feature (92)..(92): n is a, c, g, or t
gctgaacccccacgaggcagagtccctggcgctggtgggcgccatgattgaccaggtcctggagctacacccaggcgcccagcggctgcacntcgggtgtgatgaggtctattacctcggagagggggaggcctcgcgccggtggctacagcaagagcagaacagcacggggaagttgtgcctgtcacacatgcgggcggtggccagcggcgtgaaggcccggcgccccagcgtgacacccctggtgtgggacgacatgctccgagacctgcctgaggaccagctcgcagcgtccggggtgccgcagctggtggagccggtgctctgggactacacggccgacctggatgtgcacggcaaggtcctcctcatgcagaagtaccggcggtgcggctttccgcagctgtgggcagccagtgccttcaagggtgccacggggcccagccaggccgtgccccctgttgagcaccacctcaggaaccacgtgcagtggctgcaggtggcgggcagcgggcccacggactcactgcagggcatcatcctgaccggctggcagaggtacgaccactactctgtgctgtgcgagctgctgcccgcaggagtcccgtccctggccgcctgcctgcagttgcttctacgcggaggatttgatgaagatgttaaagcgaaagtggagaaccttctcgggatttccagcctggaaaaaacggaccctgttagggagggggccggctccttccctggcagcaacatccttgcccttgtcacacaagtcagcctccatctgcgcagctctgtggatgcgctgctggagggcaacaggtatgtcactggctggttcagcccctaccaccgccagcggaagctcatccacccggtcatggttcagcacatccagcccgcagcgctcagcctcctggcacagtggagcaccctcgtgcaggagctggaggctgccctgcagctggctttctacccggatgccgtggaggagtggctggaggaaaacgtgcaccccagcctgcagcggctgcaagctctgctgcaggacctcagcgaggtgtctgcccccccgctgccacccaccagccctggcagggacgttgctcaggacccctgaggggagagctcatgccagggggctcctgctggaggctgggggggctctgcactgccaaatggcctgggcaatacgggcccacgtgggcgtcgtgccctctggcccagcagtgtcttgcccacactcagttcctgagggccctgggcagcccctgggggagagactagaaaacacagaaggaagcagcacagggagacccgctttgtgatctgcatgtgtgacactgattctttggaaataaagagtggaagctgcaggtgacacg

SEQ ID NO: 288024 - DNA, 2004 bp, Homo sapiens
  misc_feature (92)..(92): n is a, c, g, or t
gctgaacccccacgaggcagagtccctggcgctggtgggcgccatgattgaccaggtcctggagctacacccaggcgcccagcggctgcacntcgggtgtgatgaggtctattacctcggagagggggaggcctcgcgccggtggctacagcaagagcagaacagcacggggaagttgtgcctgtcacacatgcgggcggtggccagcggcgtgaaggcccggcgccccagcgtgacacccctggtgtgggacgacatgctccgagacctgcctgaggaccagctcgcagcgtccggggtgccgcagctggtggagccggtgctctgggactacacggccgacctggatgtgcacggcaaggtcctcctcatgcagaagtaccggcggtgcggctttccgcagctgtgggcagccagtgccttcaagggtgccacggggcccagccaggccgtgccccctgttgagcaccacctcaggaaccacgtgcagtggctgcaggtggcgggcagcgggcccacggactcactgcagggcatcatcctgaccggctggcagaggtacgaccactactctgtgctgtgcgagctgctgcccgcaggagtcccgtccctggccgcctgcctgcagttgcttctacgcggtatgtctggtctggccaccccaagccccaccggcccctccccgaaagacccggagggcaggaggccaagcacccagtgctccaaccaccctgctggactgtggtggtcctcacagtcggaggatggtctcaccgccccagctcagccacccacctgccctgaagtccacccaggctgggcctgtgtctgggtctccaggcctaagcccaaagcaggctggagagtgacgcgggaggcacccctcagacacagtgaatccgcagaaatgcacgcaggtcggaggtggggaacggctccacctttgctgcacacacgtcctgcccacctggccgagcaggtgtggggctcaggcgcccggccctggaaggccccgcaccctggacccagcactcacacttccaggtctcctgagggagcagcgggacccatgggcaggggcaggcaccggggaacccttggggtcggcagggggcttggccagaggagctgtgtgtgtggaaactcgcaggccacacgggaaattagcgactgcgtggtgctgatgcagaaagaaaaatggccgagacgcgcggagaggtatcccgcaggcgcggcggcccagggacggggacgcggccggaggatttgatgaagatgttaaagcgaaagtggagaaccttctcgggatttccagcctggaaaaaacggaccctgttagggagggggccggctccttccctggcagcaacatccttgcccttgtcacacaagtcagcctccatctgcgcagctctgtggatgcgctgctggagggcaacaggtatgtcactggctggttcagcccctaccaccgccagcggaagctcatccacccggtcatggttcagcacatccagcccgcagcgctcagcctcctggcacagtggagcaccctcgtgcaggagctggaggctgccctgcagctggctttctacccggatgccgtggaggagtggctggaggaaaacgtgcaccccagcctgcagcggctgcaagctctgctgcaggacctcagcgaggtgtctgcccccccgctgccacccaccagccctggcagggacgttgctcaggacccctgaggggagagctcatgccagggggctcctgctggaggctgggggggctctgcactgccaaatggcctgggcaatacgggcccacgtgggcgtcgtgccctctggcccagcagtgtcttgcccacactcagttcctgagggccctgggcagcccctgggggagagactagaaaacacagaaggaagcagcacagggagacccgctttgtgatctgcatgtgtgacactgattctttggaaataaagagtggaagctgcaggtgacacg

SEQ ID NO: 288025 - DNA, 812 bp, Homo sapiens
caccatacatcagtcatctggcagcagctcgagaagcatgtcctccacgccgtcaatctgagaggcagagagagagagaaggcattgatcggccagagccctccactccctccattcctcactcctgcgccttcccctagctggaaacagcaggctggaatgcaatggtgtgatcttggctcactgcgacctccacctcctgggttcaagcgattctcctgcttctgcctcccgagtagctgggattacagacaaagaattcaagactaaactgggcatggtgacacgcacctgtagtctcagctacttgggaggctgaggcaggagaatcacatgaacctggcaggcggaggttgcagtgagccgagattgtgccactgcactccagcctggccacagagcgagactccgtctcaaaaaaaaaaaaaagagaaaaaaaggaaaaaagaagaagtcaagactaagaagagtgacgtttgaagtaattcacccacagacacccagctagtgagtggcagacctggaagacaaactagttctgtttggcatcagaatctatgctgtcagccacctcaccacattcatgtgacatccaacaaagtggtgccttcacctgctactaagtcttgctagggctagttccagagccaagactatgaagtggacaatgatctatgaagcgctaagtgaacagatgtcatgtaaatagcttggatctctacgtgcatgtgtgcattgtatatgtttaccaaagaccttgttacagtgtttttaggcatggctcactttataaaggtcatcacagttggcca

SEQ ID NO: 288026 - DNA, 939 bp, Homo sapiens
caccatacatcagtcatctggcagcagctcgagaagcatgtcctccacgccgtcaatctgagaggcagagagagagagaaggcattgatcggccagagccctccactccctccattcctcactcctgcgccttcccctagctggaaacagcaggtaggaacccaggtgtgaggatttcaggggctcttggagactgcccctcctcccaccagccttcagcctgtgactgcccaccagagatgtcttcctgcggctagctggtggctgggaggaagtggaggctggaatgcaatggtgtgatcttggctcactgcgacctccacctcctgggttcaagcgattctcctgcttctgcctcccgagtagctgggattacagacaaagaattcaagactaaactgggcatggtgacacgcacctgtagtctcagctacttgggaggctgaggcaggagaatcacatgaacctggcaggcggaggttgcagtgagccgagattgtgccactgcactccagcctggccacagagcgagactccgtctcaaaaaaaaaaaaaagagaaaaaaaggaaaaaagaagaagtcaagactaagaagagtgacgtttgaagtaattcacccacagacacccagctagtgagtggcagacctggaagacaaactagttctgtttggcatcagaatctatgctgtcagccacctcaccacattcatgtgacatccaacaaagtggtgccttcacctgctactaagtcttgctagggctagttccagagccaagactatgaagtggacaatgatctatgaagcgctaagtgaacagatgtcatgtaaatagcttggatctctacgtgcatgtgtgcattgtatatgtttaccaaagaccttgttacagtgtttttaggcatggctcactttataaaggtcatcacagttggcca

SEQ ID NO: 288027 - DNA, 761 bp, Homo sapiens
  misc_feature (761)..(761): n is a, c, g, or t
tgtgaatggctcttgactccagacctagatagccacagagcaagatgacaagctcgctaataagctctgttggggaggtctcagcccaggccagagctgtgaagtgagaaataagtccagtttaaatagtgctgctgggatggacttttgtggccagggaaggggtacccaggagccagtgtggccactgacccagcctcatcaatggccctaggatccagaatgccacaaacaatggagcaagaatcagatctgtgtgtctgggctggaatgcaatggtgtgatcttggctcactgcgacctccacctcctgggttcaagcgattctcctgcttctgcctcccgagtagctgggattacagacaaagaattcaagactaaactgggcatggtgacacgcacctgtagtctcagctacttgggaggctgaggcaggagaatcacatgaacctggcaggcggaggttgcagtgagccgagattgtgccactgcactccagcctggccacagagcgagactccgtctcaaaaaaaaaaaaaagagaaaaaaaggaaaaaaaaaaatccgggggcattatagggcgggggggcgagacaaaagcaggggtatatgaacatgtgcgcacctgtgtggccatcaacgtgtgtttcctggaccccaagtttttttgtgttccccaacgggggaaatctgcggagggatcccataaaagagacacgcatttaaactctcagataagccagggtaccctggattaaggn

SEQ ID NO: 288028 - DNA, 332 bp, Homo sapiens
gggctcagacaaggagctatggtgagaatccggaccagcctgggagttgtgtgtcataggtgccatgatggaggtggtgggtagacatcataatgcctgttagcatgtaatagatgcctatgatgtgcccaaacttgtattggattcatcccatgccttccttcatttgctccttataataaccctacaaagcaggtttcattatcaccatcagttattattattcttatttttcagacaaagaattcaagactaaactgggcatggtgacacgcacctgtagtctcagctacttgggaggctgaggcaggagaatcacatgaacctggcag

SEQ ID NO: 288029 - DNA, 1445 bp, Homo sapiens
ggcgaagggggctgggcgggtggcgccgccgcttgggcgccgggagggtggcagcacgcgtgggcgcggcgagggctgccttctccctcgccctcccgcccccaggagtccggctccccgacggcagagcggcggggaaagggtggggggagggagctggaggaaaagaaggggtcggccgagtctcttaccttgctctccgctgggagttgggcgggctgggtggcccggggaggggaaaagggtcgggggagggggtggggaaaggggggagcccttgcgaggtgtagcttccgagcagctcccgccgccgccacagccggcgcctcctttccgattcactcaaacaaacaagatggctgccgttacgccgcggctcttcctgccgcccaaatcctcggttcaaatcggcaggatgtttacggtcaaaatggtacctgtgcgcctgcgccagcccaagcccccccctccccccagaaggagcggccaggcgcaatgactatttccttttctttggaacccgccctctgtttgtggagtccacaactgagcaagcgcaaagagatctttccagtgatgaaagaaattgaagaggacacacaaaaatggaaatatattccatgttcatggattggaagaatcaatattgttaaaatttccatactacccagagcaatctacagattcaatgtaatccctatcaaaatatcaatgacattcttcacagaaagaggaaaaaaatcctaaaatttatatggaaccacaataagaccaagaatagccaaagcaatcctgagcaaaagaataaagctggaggcatcacattacctgacttcaaattatactacaaagtgatagtaaacaaaacagcatggtgctggcataaaaacagacacatagactaacggaacagaatagaggacctataaataaatcaatacatatacagtcaactaatttctgacaaagctgccaagaacatacgttgggaaaaggatggtctcttccaaaaattgttctggaaaaactagataactatatgtagaagaatgaaacagatcactatcttttgccatattaaaaaaatcaaaacaaaatggcttgaagactggaatctaagatttgaaactattgaaactactagaagaaaacgttagggaaatgctccagaaccaaatatttcttagtaagaccttaaaagcataggcaagcaaagcaaaaatggacaaatgggatcatgccaagctaagaaccttctgcaaagcaaacaacaaagtgaagagacaacccatcaagtgggggaaaatacttgcaaactactcatctatcacagaattaatagccataatatataaggagctcaaacaatataataggaaaataatccaattaaaattgagcaaaagacctgaatggttatttctcaaaaaagacatacaaatggc

SEQ ID NO: 288030 - DNA, 4369 bp, Homo sapiens
  misc_feature (33)..(33): n is a, c, g, or t
  misc_feature (100)..(100): n is a, c, g, or t
  misc_feature (1224)..(1224): n is a, c, g, or t
cccgggcctcctcccgctttctctctccgcttnccctggagcctccgaggagtccgcagccgctgggcgcccgggaagatggcggcggcggcgggagacngcggcggcgaggggggcgcgggcctgggcagcgcggcggggctggggccggggccggggctgcgcgggcagggcccctcagccgaagcgcacgagggcgccccggacccgatgcccgccgcgctgcaccctgaggaggtcgccgcgcgactgcagcggatgcagcgggagctgagcaaccgcaggaaaatcctggtgaaaaacctgccccaggacagcaactgccaggaagttcatgatttgttaaaagactatgacttaaaatattgttatgtggacagaaataaacgaacagcttttgttaccttattgaatggggaacaagcccagaacgcaattcagatgtttcatcaatattcttttagaggaaaagacttaatagtccagcttcagccaacagatgctttgttgtgtattaccaacgtgcccatttcttttacatcagaagagtttgaagaacttgttcgtgcttatggaaatattgagagatgttttctggtctatagtgaagttactggccattccaaaggctatggatttgtggaatacatgaaaaaggactttgctgcaaaggctagactggagctattgggtagacagttgggagcatcagcactctttgcacaatggatggatgttaatctattggcttcagagctcattcattctaagtgcctttgtattgataaactccccagtgactacagggattcagaagagctgttgcaaattttttccagtgtccataaacctgtgttttgccagcttgcacaggatgaaggtagttacgttggtggctttgcagtggttgaatatagcactgcggagcaggctgaagaggtccagcaggcagcagacggtatgaccatcaagggcagcaaagtccaggtttccttctgtgctcctggagcgccagggcgaagtacattagcagcattgatagcggctcaacgtgtgatgcacagtaatcaaaagggcttacttccagagccaaatccagtacaaattatgaaaagtttaaacaaccctgccatgttgcaagttcttctacagccccagttatgtggacgagctgttaaaccagccgttcttggaacacctcacagcttgccacatctgatgaanccatccatctctcctgcatttttacatttgaataaagcacatcagaatctttctcatataccactggcacaacaacaattaatgaagtttgagaatattcatactaataataaacccggcttacttggagagcccccagctgtggtacttcagactgcactagggatagggtcagtgcttccattgaaaaaggagttgggacatcatcatggagaagcacataaaacatctagcctgattccaactcaaacaacgataacagctggaatgggcatgttaccattctttccaaatcagcacattgctggacaggctgggccagggcacagtaatactcaggagaaacagccagccacggtgggaatggcagaaggaaatttctcagggtcgcagccttatcttcagagctttccaaaccttgctgctggaagcttgctggtgggacaccataagcagcagcaaagccagccaaaaggcacagagataagttcaggggctgcctctaagaatcaaacttcactcttgggagaaccaccaaaagaaattcggctcagtaaaaatccatacttgaatttggcaagtgtgttgcccagtgtgtgcttatcatcccctgcaagtaaaaccactcttcataagactggaattgcaagcagcattctggatgcaatctctcagggaagtgaatcacaacacgcattggaaaagtgcattgcttattctccaccttttggtgattatgcacaggtgtcatctttaagaaatgaaaagcgaggctcatcatatctcatctctgccccagaaggtggttcagtggaatgtgttgaccagcattctcagggcacaggagcatattacatggaaacttacttaaaaaagaagcgagtatactgagttaagctctctcctaataaccccctaaggttctctgcagtatctctgctgttcatcgctgccttaacttcattcaaactagccatatcctttaaatacgggtttatagtttcccagaaggaactgtgttgtgcagcaggcagaaatgccaaataaaaaatagcaataagaagagacatcaattgaggacattttccactagagtcagatgcatcttaatcagtgtgctaacttacaatccattggagaaactaacaatgttccaatattccttgatttaggactgggaataattctgacaccatatataaaagaagtttgaagcaataaatgggaaacagtgttgtttcctgagccttagaagaatgagtttcttataagccaatgtgcatttcaatttactttccctagaagtaattgcatttatagatttttaggacttttcctagaactacaagggtgcaagtaccaaatgtgctgatggtaatattataaagatgctctacatgcacactcaattacgcccacaccagccatgcaaaattaaacccggtaagagagtgacagtgatgtccaaggtatccactactaccgatgctttaagatgttgtttaccatttataccttctgtgaaaaatagaaggtattttaagaaaagtaactttggtgatctaataaaagggtttggcaaactacaccctgggtccacatttggtctaccacccgcttttgtgctgcctgcaagctaagactaatgtttacatttttaaatggttggaggaaaaaagaaaacttatgacatgaaatttatatgaaattcagatttcagtgtccataaataaacttttattgggacgttgccatgctcattcatttacgtgttgtctgtggcactcttacgctacaagggcagaactgattagcttcaacagagactgtatggcctacaaagaccatatggcctaaaatttcaagtatctggccatttatatatagtttgctgatccctgatctaatagcactaattctaatagcaactattcctttcaattcacctaaagacagacctttagcctttagacagacttgtaagtggaaaggaacatgggtttctgtgctcatttcatagcgtagactagtaatgatctaatgactagaatggggcctattttgatcactaaatgccctatttccacaatatagtatagtaaagcagtcaatactgcactttctgatggagtcttaaggagtcacagtatttataaccattttgagctaataagctatacctcactctctgctttctctctcactctttttgatagtgtgttagggtgaaaaatcagttatttaacccaatttacttgtgaaagaagttttatctttatggactatgatgacttttgacatcaccatttcttgaagaccttggtattaaatgcatgagaaaccttttgccatctagaaatttctaagtttgtttatgttataagactgtaattaattgatagggaatttgggatctcaatccggggctttttgaaatcagatcattaaatatctcgtcactttggggacttgttatttttaactatgatgtggatatcctgttttaattatgaagtctagaattggtacatatgttgtatgctttgtaaagaatttcacttggtctaatttattgcatatactagcttctgttggaaaatgactgacagctagaaagtttaaggtaatttctaagtatactacctataagtaactgataagaattaggcatcattcagtgatatagcagatgactaatgggtttttcaggccctgcacttctctttcccattttcctgttgcattcagcctcttcaatgcttagtcacacctccactatagtacaaacaaacaaacaaacagaagaaaggaaagatggtgaattttgcaacagagctgcaaaaagtcagtcaaagcaggaagaggttgaaggaactaaaacaaacaaacaaaggtgtctggactacagcacagtggacatgccatccatactggcctgtgccccgttatcaatcactgggcacaacagtgaagaagtgcaaatcaagtggtgtttgtttgtttgtttgtagtaaggaccgtaacccaccccttcctccccccaaaactatactgttatttttctatgtaagcaaattgtttgaaatgctttgaaaatgaaatcttaatattaaaaggcatatgcatgtaaaaatctttagtatat

SEQ ID NO: 288031 - DNA, 641 bp, Homo sapiens
tatgtatatatatcagacagagacattttattatatcattaatgtcacagaatgaagcatattgattttgaaacatttttaacaatgggagaaagttatatttttaaataaaaatttaaaaatgtttaatgcagaaataatgataaaattaattcatgtttctgtaggtctgaaatctaaaagctggacttgaagctataagaaagggacattaggggcttgattcagatctcaggagaactagtgcagtcccattttggttctccgtatacctgactccactgaagagacaagacttagaaaaggtgaagtggggctgaaggtaagggtgagactgaggagtccttgaggcagaattttctgaaaacaaatttcattttgtatttaaagggctacctgctagatgcttatattcttttcagaagaacaacaataataaatatctttaattggactgatagcagatgagcctaatggaattcactgttgacattaacatatcccaaaggaatcttctgagggatagtcaagattcccctttccccaattcttacgatggctttgaaaactagccaccagttcaattattgacatgagcttaaaaattgagcttaagatacattgtattaaaaactggcagt

SEQ ID NO: 288032 - DNA, 3302 bp, Homo sapiens
  misc_feature (33)..(33): n is a, c, g, or t
  misc_feature (100)..(100): n is a, c, g, or t
  misc_feature (1142)..(1142): n is a, c, g, or t
cccgggcctcctcccgctttctctctccgcttnccctggagcctccgaggagtccgcagccgctgggcgcccgggaagatggcggcggcggcgggagacngcggcggcgaggggggcgcgggcctgggcagcgcggcgcgctgcaccctgaggaggtcgccgcgcgactgcagcggatgcagcgggagctgagcaaccgcaggaaaatcctggtgaaaaacctgccccaggacagcaactgccaggaagttcatgatttgttaaaagactatgacttaaaatattgttatgtggacagaaataaacgaacagcttttgttaccttattgaatggggaacaagcccagaacgcaattcagatgtttcatcaatattcttttagaggaaaagacttaatagtccagcttcagccaacagatgctttgttgtgtattaccaacgtgcccatttcttttacatcagaagagtttgaagaacttgttcgtgcttatggaaatattgagagatgttttctggtctatagtgaagttactggccattccaaaggctatggatttgtggaatacatgaaaaaggactttgctgcaaaggctagactggagctattgggtagacagttgggagcatcagcactctttgcacaatggatggatgttaatctattggcttcagagctcattcattctaagtgcctttgtattgataaactccccagtgactacagggattcagaagagctgttgcaaattttttccagtgtccataaacctgtgttttgccagcttgcacaggatgaaggtagttacgttggtggctttgcagtggttgaatatagcactgcggagcaggctgaagaggtccagcaggcagcagacggtatgaccatcaagggcagcaaagtccaggtttccttctgtgctcctggagcgccagggcgaagtacattagcagcattgatagcggctcaacgtgtgatgcacagtaatcaaaagggcttacttccagagccaaatccagtacaaattatgaaaagtttaaacaaccctgccatgttgcaagttcttctacagccccagttatgtggacgagctgttaaaccagccgttcttggaacacctcacagcttgccacatctgatgaanccatccatctctcctgcatttttacatttgaataaagcacatcagaatctttctcatataccactggcacaacaacaattaatgaagtttgagaatattcatactaataataaacccggcttacttggagagcccccagctgtggtacttcagactgcactagggatagggtcagtgcttccattgaaaaaggagttgggacatcatcatggagaagcacataaaagctgcctctaagaatcaaacttcactcttgggagaaccaccaaaagaaattcggctcagtaaaaatccatacttgaatttggcaagtgtgttgcccagtgtgtgcttatcatcccctgcaagtaaaaccactcttcataagactggaattgcaagcagcattctggatgcaatctctcagggaagtgaatcacaacacgcattggaaaagtgcattgcttattctccaccttttggtgattatgcacaggtaaataattcccaggttctgatgatactcagaaaaattggttcaactatatattgagttcactgaatatgaaattgtgatttctatattattaacgtaggcaaatcaaattgcactgatctatgtatttcttactcatcatttgaaatttgggaatgtgttcaagacattatttagtatcattttgcactagatatttacctctcactgtttacctagtggttggcaaactacagcccatagaacaaatctagcccaccacctggttttgtaaataaatttgtattgtaatacagccatgtccattcattaacatattgtctatggtgctgtcatgctataataaaagagttgagtgatgacagtagagactatgtggcctgcaagattaaatatttactatctggttctttatagaaaaatgctgctaacctctggtttgcactagtgtagacctaagaaacccaagggaatgcctctgttcttctccactgattgtagatggagaaagatgatcatatttacagacactactgtgctaacttctaaaccagccaatcaataacataaaaatattatgttcataagatgtcctgtgtcattacttaaatatttcagttttgctttggcccttcttcagcttactcttagtggtgtaagctgaatatatatcatgttagccctgtgtgattatggaatcataagagtccacaagagtcttataattatcagttctgactcttactttcctagaacagccagcttcttctcagatctatcctgttcgttggagtcttgtctccactttgatttccctggagcagctttgtgtttgcctgacccatccctaataaacttagaaaagaaaaccacttagaacaattgacgcctgattataagagtactagaacagcccaagttctgtaaaaatggtgcagctggatattagtgaaatatttgccatctcttatatacctgggacaagacggaaaaatatgggttgggtagatgatgtaattaggtgacagtatatctatatttagagaacagtgatcacaaattgctgcagtctgaaggcattctcttatattgattcataagagtcatcttcagtcctttattagataacatttgaagtaatgacttagataaagacattaattgtaaaatttacaagatatagtcctgtacaattccaatttgtttcttttcaagaaacaaactttttataaacaggagaagcacaataaattttttaaaaattcattaaatacatatttaagctttaaaaattttttgaacttttatttctttttaaatttgcctttttcttagcagttttgcttattagattactgtgatttattgtatacttatatccatggaaagactttctcattcacacatggagaaattctgtgataatgatgccttttgcattactgtatgtcttctgcctccacacttgcttgcccagagatatggtggggaaatgaatcctccctgcactgttcagtgtctcctttgacagtccctgcttctagcgcacgcttgttcataaaatgggatttgttctctctctcgtgttctttcttccttataaacttaattaaatgttactaatggaacattaaagtacatggaattaaactaatggaatactaaaataaccattatagaaaaag

SEQ ID NO: 288033 - DNA, 4425 bp, Homo sapiens
  misc_feature (33)..(33): n is a, c, g, or t
  misc_feature (100)..(100): n is a, c, g, or t
  misc_feature (1142)..(1142): n is a, c, g, or t
cccgggcctcctcccgctttctctctccgcttnccctggagcctccgaggagtccgcagccgctgggcgcccgggaagatggcggcggcggcgggagacngcggcggcgaggggggcgcgggcctgggcagcgcggcgcgctgcaccctgaggaggtcgccgcgcgactgcagcggatgcagcgggagctgagcaaccgcaggaaaatcctggtgaaaaacctgccccaggacagcaactgccaggaagttcatgatttgttaaaagactatgacttaaaatattgttatgtggacagaaataaacgaacagcttttgttaccttattgaatggggaacaagcccagaacgcaattcagatgtttcatcaatattcttttagaggaaaagacttaatagtccagcttcagccaacagatgctttgttgtgtattaccaacgtgcccatttcttttacatcagaagagtttgaagaacttgttcgtgcttatggaaatattgagagatgttttctggtctatagtgaagttactggccattccaaaggctatggatttgtggaatacatgaaaaaggactttgctgcaaaggctagactggagctattgggtagacagttgggagcatcagcactctttgcacaatggatggatgttaatctattggcttcagagctcattcattctaagtgcctttgtattgataaactccccagtgactacagggattcagaagagctgttgcaaattttttccagtgtccataaacctgtgttttgccagcttgcacaggatgaaggtagttacgttggtggctttgcagtggttgaatatagcactgcggagcaggctgaagaggtccagcaggcagcagacggtatgaccatcaagggcagcaaagtccaggtttccttctgtgctcctggagcgccagggcgaagtacattagcagcattgatagcggctcaacgtgtgatgcacagtaatcaaaagggcttacttccagagccaaatccagtacaaattatgaaaagtttaaacaaccctgccatgttgcaagttcttctacagccccagttatgtggacgagctgttaaaccagccgttcttggaacacctcacagcttgccacatctgatgaanccatccatctctcctgcatttttacatttgaataaagcacatcagaatctttctcatataccactggcacaacaacaattaatgaagtttgagaatattcatactaataataaacccggcttacttggagagcccccagctgtggtacttcagactgcactagggatagggtcagtgcttccattgaaaaaggagttgggacatcatcatggagaagcacataaaacatctagcctgattccaactcaaacaacgataacagctggaatgggcatgttaccattctttccaaatcagcacattgctggacaggctgggccagggcacagtaatactcaggagaaacagccagccacggtgggaatggcagaaggaaatttctcagggtcgcagccttatcttcagagctttccaaaccttgctgctggaagcttgctggtgggacaccataagcagcagcaaagccagccaaaaggcacagagataagttcaggggctgcctctaagaatcaaacttcactcttgggagaaccaccaaaagaaattcggctcagtaaaaatccatacttgaatttggcaagtgtgttgcccagtgtgtgcttatcatcccctgcaagtaaaaccactcttcataagactggaattgcaagcagcattctggatgcaatctctcagggaagtgaatcacaacacgcattggaaaagtgcattgcttattctccaccttttggtgattatgcacaggtctgaaatctaaaagctggacttgaagctataagaaagggacattaggggcttgattcagatctcaggagaactagtgcagtcccattttggttctccgtatacctgactccactgaagagacaagacttagaaaaggtgtcatctttaagaaatgaaaagcgaggctcatcatatctcatctctgccccagaaggtggttcagtggaatgtgttgaccagcattctcagggcacaggagcatattacatggaaacttacttaaaaaagaagcgagtatactgagttaagctctctcctaataaccccctaaggttctctgcagtatctctgctgttcatcgctgccttaacttcattcaaactagccatatcctttaaatacgggtttatagtttcccagaaggaactgtgttgtgcagcaggcagaaatgccaaataaaaaatagcaataagaagagacatcaattgaggacattttccactagagtcagatgcatcttaatcagtgtgctaacttacaatccattggagaaactaacaatgttccaatattccttgatttaggactgggaataattctgacaccatatataaaagaagtttgaagcaataaatgggaaacagtgttgtttcctgagccttagaagaatgagtttcttataagccaatgtgcatttcaatttactttccctagaagtaattgcatttatagatttttaggacttttcctagaactacaagggtgcaagtaccaaatgtgctgatggtaatattataaagatgctctacatgcacactcaattacgcccacaccagccatgcaaaattaaacccggtaagagagtgacagtgatgtccaaggtatccactactaccgatgctttaagatgttgtttaccatttataccttctgtgaaaaatagaaggtattttaagaaaagtaactttggtgatctaataaaagggtttggcaaactacaccctgggtccacatttggtctaccacccgcttttgtgctgcctgcaagctaagactaatgtttacatttttaaatggttggaggaaaaaagaaaacttatgacatgaaatttatatgaaattcagatttcagtgtccataaataaacttttattgggacgttgccatgctcattcatttacgtgttgtctgtggcactcttacgctacaagggcagaactgattagcttcaacagagactgtatggcctacaaagaccatatggcctaaaatttcaagtatctggccatttatatatagtttgctgatccctgatctaatagcactaattctaatagcaactattcctttcaattcacctaaagacagacctttagcctttagacagacttgtaagtggaaaggaacatgggtttctgtgctcatttcatagcgtagactagtaatgatctaatgactagaatggggcctattttgatcactaaatgccctatttccacaatatagtatagtaaagcagtcaatactgcactttctgatggagtcttaaggagtcacagtatttataaccattttgagctaataagctatacctcactctctgctttctctctcactctttttgatagtgtgttagggtgaaaaatcagttatttaacccaatttacttgtgaaagaagttttatctttatggactatgatgacttttgacatcaccatttcttgaagaccttggtattaaatgcatgagaaaccttttgccatctagaaatttctaagtttgtttatgttataagactgtaattaattgatagggaatttgggatctcaatccggggctttttgaaatcagatcattaaatatctcgtcactttggggacttgttatttttaactatgatgtggatatcctgttttaattatgaagtctagaattggtacatatgttgtatgctttgtaaagaatttcacttggtctaatttattgcatatactagcttctgttggaaaatgactgacagctagaaagtttaaggtaatttctaagtatactacctataagtaactgataagaattaggcatcattcagtgatatagcagatgactaatgggtttttcaggccctgcacttctctttcccattttcctgttgcattcagcctcttcaatgcttagtcacacctccactatagtacaaacaaacaaacaaacagaagaaaggaaagatggtgaattttgcaacagagctgcaaaaagtcagtcaaagcaggaagaggttgaaggaactaaaacaaacaaacaaaggtgtctggactacagcacagtggacatgccatccatactggcctgtgccccgttatcaatcactgggcacaacagtgaagaagtgcaaatcaagtggtgtttgtttgtttgtttgtagtaaggaccgtaacccaccccttcctccccccaaaactatactgttatttttctatgtaagcaaattgtttgaaatgctttgaaaatgaaatcttaatattaaaaggcatatgcatgtaaaaatctttagtatat

SEQ ID NO: 288034 - DNA, 3477 bp, Homo sapiens
  misc_feature (33)..(33): n is a, c, g, or t
  misc_feature (100)..(100): n is a, c, g, or t
  misc_feature (1142)..(1142): n is a, c, g, or t
  misc_feature (3441)..(3441): n is a, c, g, or t
  misc_feature (3455)..(3455): n is a, c, g, or t
  misc_feature (3476)..(3476): n is a, c, g, or t
cccgggcctcctcccgctttctctctccgcttnccctggagcctccgaggagtccgcagccgctgggcgcccgggaagatggcggcggcggcgggagacngcggcggcgaggggggcgcgggcctgggcagcgcggcgcgctgcaccctgaggaggtcgccgcgcgactgcagcggatgcagcgggagctgagcaaccgcaggaaaatcctggtgaaaaacctgccccaggacagcaactgccaggaagttcatgatttgttaaaagactatgacttaaaatattgttatgtggacagaaataaacgaacagcttttgttaccttattgaatggggaacaagcccagaacgcaattcagatgtttcatcaatattcttttagaggaaaagacttaatagtccagcttcagccaacagatgctttgttgtgtattaccaacgtgcccatttcttttacatcagaagagtttgaagaacttgttcgtgcttatggaaatattgagagatgttttctggtctatagtgaagttactggccattccaaaggctatggatttgtggaatacatgaaaaaggactttgctgcaaaggctagactggagctattgggtagacagttgggagcatcagcactctttgcacaatggatggatgttaatctattggcttcagagctcattcattctaagtgcctttgtattgataaactccccagtgactacagggattcagaagagctgttgcaaattttttccagtgtccataaacctgtgttttgccagcttgcacaggatgaaggtagttacgttggtggctttgcagtggttgaatatagcactgcggagcaggctgaagaggtccagcaggcagcagacggtatgaccatcaagggcagcaaagtccaggtttccttctgtgctcctggagcgccagggcgaagtacattagcagcattgatagcggctcaacgtgtgatgcacagtaatcaaaagggcttacttccagagccaaatccagtacaaattatgaaaagtttaaacaaccctgccatgttgcaagttcttctacagccccagttatgtggacgagctgttaaaccagccgttcttggaacacctcacagcttgccacatctgatgaanccatccatctctcctgcatttttacatttgaataaagcacatcagaatctttctcatataccactggcacaacaacaattaatgaagtttgagaatattcatactaataataaacccggcttacttggagagcccccagctgtggtacttcagactgcactagggatagggtcagtgcttccattgaaaaaggagttgggacatcatcatggagaagcacataaaacatctagcctgattccaactcaaacaacgataacagctggaatgggcatgttaccattctttccaaatcagcacattgctggacaggctgggccagggcacagtaatactcaggagaaacagccagccacggtgggaatggcagaaggaaatttctcagggtcgcagccttatcttcagagctttccaaaccttgctgctggaagcttgctggtgggacaccataagcagcagcaaagccagccaaaaggcacagagataagttcaggggctgcctctaagaatcaaacttcactcttgggagaaccaccaaaagaaattcggctcagtaaaaatccatacttgaatttggcaagtgtgttgcccagtgtgtgcttatcatcccctgcaagtaaaaccactcttcataagactggaattgcaagcagcattctggatgcaatctctcagggaagtgaatcacaacacgcattggaaaagtgcattgcttattctccaccttttggtgattatgcacaggtgtcatctttaagaaatgaaaagcgaggctcatcatatctcatctctgccccagaaggtggttcagtggaatgtgttgaccagcattctcagggcacaggagcatattacatggaaacttacttaaaaaagaagcgagtatactgagttaagctctctcctaataaccccctaaggttctctgcagtatctctgctgttcatcgctgccttaacttcattcaaactagccatatcctttaaatacgggtttatagtttcccagaaggaactgtgttgtgcagcaggcagaaatgccaaataaaaaatagcaataagaagagacatcaattgaggacattttccactagagtcagatgcatcttaatcagtgtgctaacttacaatccattggagaaactaacaatgttccaatattccttgatttaggactgggaataattctgacaccatatataaaagaagtttgaagcaataaatgggaaacagtgttgtttcctgagccttagaagaatgagtttcttataagccaatgtgcatttcaatttactttccctagaagtaattgcatttatagatttttaggacttttcctagaactacaagggtgcaagtaccaaatgtgctgatggtaatattataaagatgctctacatgcacactcaattacgcccacaccagccatgcaaaattaaacccggtaagagagtgacagtgatgtccaaggtatccactactaccgatgctttaagatgttgtttaccatttataccttctgtgaaaaatagaaggtattttaagaaaagtaactttggtgatctaataaaagggtttggcaaactacaccctgggtccacatttggtctaccacccgcttttgtgctgcctgcaagctaagactaatgtttacatttttaaatggttggaggaaaaaagaaaacttatgacatgaaatttatatgaaattcagatttcagtgtccataaataaacttttattgggacgttgccatgctcattcatttacgtgttgtctgtggcactcttacgctacaagggcagaactgattagcttcaacagagactgtatggcctacaaagaccatatggcctaaaatttcaagtatctggccatttatatatagtttgctgatccctgatctaatagcactaattctaatagcaactattcctttcaattcacctaaagacagacctttagcctttagacagacttgtaagtggaaaggaacatgggtttctgtgctcatttcatagcgtagactagtaatgatctaatgactagaatggggcctattttgatcactaaatgccctatttccacaatatagtatagtaaagcagtcaatactgcactttctgatggagtcttaaggagtcacagtatttataaccattttgagctaataagctatacctcactctctgctttctctctcactctttttgatagtgtgttagggtgaaaaatcagttatttaacccaatttacttgtgaaagaagttttatctttatgacaccgtggggggatcctnaagagtcggggtgnttccaaagagttcacatattna

SEQ ID NO: 288035 - DNA, 2888 bp, Homo sapiens
  misc_feature (33)..(33): n is a, c, g, or t
  misc_feature (100)..(100): n is a, c, g, or t
  misc_feature (1142)..(1142): n is a, c, g, or t
cccgggcctcctcccgctttctctctccgcttnccctggagcctccgaggagtccgcagccgctgggcgcccgggaagatggcggcggcggcgggagacngcggcggcgaggggggcgcgggcctgggcagcgcggcgcgctgcaccctgaggaggtcgccgcgcgactgcagcggatgcagcgggagctgagcaaccgcaggaaaatcctggtgaaaaacctgccccaggacagcaactgccaggaagttcatgatttgttaaaagactatgacttaaaatattgttatgtggacagaaataaacgaacagcttttgttaccttattgaatggggaacaagcccagaacgcaattcagatgtttcatcaatattcttttagaggaaaagacttaatagtccagcttcagccaacagatgctttgttgtgtattaccaacgtgcccatttcttttacatcagaagagtttgaagaacttgttcgtgcttatggaaatattgagagatgttttctggtctatagtgaagttactggccattccaaaggctatggatttgtggaatacatgaaaaaggactttgctgcaaaggctagactggagctattgggtagacagttgggagcatcagcactctttgcacaatggatggatgttaatctattggcttcagagctcattcattctaagtgcctttgtattgataaactccccagtgactacagggattcagaagagctgttgcaaattttttccagtgtccataaacctgtgttttgccagcttgcacaggatgaaggtagttacgttggtggctttgcagtggttgaatatagcactgcggagcaggctgaagaggtccagcaggcagcagacggtatgaccatcaagggcagcaaagtccaggtttccttctgtgctcctggagcgccagggcgaagtacattagcagcattgatagcggctcaacgtgtgatgcacagtaatcaaaagggcttacttccagagccaaatccagtacaaattatgaaaagtttaaacaaccctgccatgttgcaagttcttctacagccccagttatgtggacgagctgttaaaccagccgttcttggaacacctcacagcttgccacatctgatgaanccatccatctctcctgcatttttacatttgaataaagcacatcagaatctttctcatataccactggcacaacaacaattaatgaagtttgagaatattcatactaataataaacccggcttacttggagagcccccagctgtggtacttcagactgcactagggatagggtcagtgcttccattgaaaaaggagttgggacatcatcatggagaagcacataaaacatctagcctgattccaactcaaacaacgataacagctggaatgggcatgttaccattctttccaaatcagcacattgctggacaggctgggccagggcacagtaatactcaggagaaacagccagccacggtgggaatggcagaaggaaatttctcagggtcgcagccttatcttcagagctttccaaaccttgctgctggaagcttgctggtgggacaccataagcagcagcaaagccagccaaaaggcacagagataagttcaggggctgcctctaagaatcaaacttcactcttgggagaaccaccaaaagaaattcggctcagtaaaaatccatacttgaatttggcaagtgtgttgcccagtgtgtgcttatcatcccctgcaagtaaaaccactcttcataagactggaattgcaagcagcattctggatgcaatctctcagggaagtgaatcacaacacgcattggaaaagtgcattgcttattctccaccttttggtgattatgcacaggtgtcatctttaagaaatgaaaagcgaggctcatcatatctcatctctgccccagaaggtggttcagtggaatgtgttgaccagcattctcagggcacaggagcatattacatggaaacttacttaaaaaagaagcgagtatactgagttaagctctctcctaataaccccctaaggttctctgcagtatctctgctgttcatcgctgccttaacttcattcaaactagccatatcctttaaatacgggtttatagtttcccagaaggaactgtgttgtgcagcaggcagaaatgccaaataaaaaatagcaataagaagagacatcaattgaggacattttccactagagtcagatgcatcttaatcagtgtgctaacttacaatccattggagaaactaacaatgttccaatattccttgatttaggactgggaataattctgacaccatatataaaagaagtttgaagcaataaatgggaaacagtgttgtttcctgagccttagaagaatgagtttcttataagccaatgtgcatttcaatttactttccctagaagtaattgcatttatagatttttaggacttttcctagaactacaagggtgcaagtaccaaatgtgctgatggtaatattataaagatgctctacatgcacactcaattacgcccacaccagccatgcaaaattaaacccggtaagagagtgacagtgatgtccaaggtatccactactaccgatgctttaagatgttgtttaccatttataccttctgtgaaaaatagaaggtattttaagaaaagtaactttggtgatctaataaaagggtttggcaaactacaccctgggtccacatttggtctaccacccgcttttgtgctgcctgcaagctaagactaatgtttacatttttaaatggttggaggaaaaaagaaaacttatgacatgaaatttatatgaaattcagatttcagtgtccataaataaacttttattggga

SEQ ID NO: 288036 - DNA, 2360 bp, Homo sapiens
  misc_feature (33)..(33): n is a, c, g, or t
  misc_feature (100)..(100): n is a, c, g, or t
  misc_feature (1142)..(1142): n is a, c, g, or t
cccgggcctcctcccgctttctctctccgcttnccctggagcctccgaggagtccgcagccgctgggcgcccgggaagatggcggcggcggcgggagacngcggcggcgaggggggcgcgggcctgggcagcgcggcgcgctgcaccctgaggaggtcgccgcgcgactgcagcggatgcagcgggagctgagcaaccgcaggaaaatcctggtgaaaaacctgccccaggacagcaactgccaggaagttcatgatttgttaaaagactatgacttaaaatattgttatgtggacagaaataaacgaacagcttttgttaccttattgaatggggaacaagcccagaacgcaattcagatgtttcatcaatattcttttagaggaaaagacttaatagtccagcttcagccaacagatgctttgttgtgtattaccaacgtgcccatttcttttacatcagaagagtttgaagaacttgttcgtgcttatggaaatattgagagatgttttctggtctatagtgaagttactggccattccaaaggctatggatttgtggaatacatgaaaaaggactttgctgcaaaggctagactggagctattgggtagacagttgggagcatcagcactctttgcacaatggatggatgttaatctattggcttcagagctcattcattctaagtgcctttgtattgataaactccccagtgactacagggattcagaagagctgttgcaaattttttccagtgtccataaacctgtgttttgccagcttgcacaggatgaaggtagttacgttggtggctttgcagtggttgaatatagcactgcggagcaggctgaagaggtccagcaggcagcagacggtatgaccatcaagggcagcaaagtccaggtttccttctgtgctcctggagcgccagggcgaagtacattagcagcattgatagcggctcaacgtgtgatgcacagtaatcaaaagggcttacttccagagccaaatccagtacaaattatgaaaagtttaaacaaccctgccatgttgcaagttcttctacagccccagttatgtggacgagctgttaaaccagccgttcttggaacacctcacagcttgccacatctgatgaanccatccatctctcctgcatttttacatttgaataaagcacatcagaatctttctcatataccactggcacaacaacaattaatgaagtttgagaatattcatactaataataaacccggcttacttggagagcccccagctgtggtacttcagactgcactagggatagggtcagtgcttccattgaaaaaggagttgggacatcatcatggagaagcacataaaacatctagcctgattccaactcaaacaacgataacagctggaatgggcatgttaccattctttccaaatcagcacattgctggacaggctgggccagggcacagtaatactcaggagaaacagccagccacggtgggaatggcagaaggaaatttctcagggtcgcagccttatcttcagagctttccaaaccttgctgctggaagcttgctggtgggacaccataagcagcagcaaagccagccaaaaggcacagagataagttcaggggctgcctctaagaatcaaacttcactcttgggagaaccaccaaaagaaattcggctcagtaaaaatccatacttgaatttggcaagtgtgttgcccagtgtgtgcttatcatcccctgcaagtaaaaccactcttcataagactggaattgcaagcagcattctggatgcaatctctcagggaagtgaatcacaacacgcattggaaaagtgcattgcttattctccaccttttggtgattatgcacaggtctgaaatctaaaagctggacttgaagctataagaaagggacattaggggcttgattcagatctcaggagaactagtgcagtcccattttggttctccgtatacctgactccactgaagagacaagacttagaaaaggtgaagtggggctgaaggtaagggtgagactgaggagtccttgaggcagaattttctgaaaacaaatttcattttgtatttaaagggctacctgctagatgcttatattcttttcagaagaacaacaataataaatatctttaattggactgatagcagatgagcctaatggaattcactgttgacattaacatatcccaaaggaatcttctgagggatagtcaagattcccctttccccaattcttacgatggctttgaaaactagccaccagttcaattattgacatgagcttaaaaattgagcttaagatacattgtattaaaaactggcagt

SEQ ID NO: 288037 - DNA, 553 bp, Homo sapiens
gctgttcttatttgctgaaagagaaaagaccacagaattgaataccagtgatttcccgttttcttaactctactgaaaagtcataaaactgcattagcaataattacaactacagttgacccttgaacaacatgggattaaactgtgtgggtccacttacatgcagattttcttccacttctgccaccctgaggcagcaagtcagctcctctgctccctccttctcctcagcctactctccacaaagatgataaagaagacctttatatgatccacttccacttaattaatatgtatccaaatcatgagcagcatcttgtgaccctagaagaaataaatgataccaccttgaacacaaatataatcatcttgaacttttatataaatttctacagcaattctgttattaaaaaaaaaagaccaacaacttggaaggaccttagtccaactttctgaagggcaatttgataacagtcatcctacataaactcctggactctgaaatcctacttctaaaaatttgtcctaaaagttatagatgttgcaaagatta

SEQ ID NO: 288038 - DNA, 460 bp, Homo sapiens
atgccaaaacaagaaatcaagacagaggctaagagagagaaattctcaatttaaaacaaagaaaaatgtgcttgaaaatcataaaactgcattagcaataattacaactacagttgacccttgaacaacatgggattaaactgtgtgggtccacttacatgcagattttcttccacttctgccaccctgaggcagcaagtcagctcctctgctccctccttctcctcagcctactctccacaaagatgataaagaagacctttatatgatccacttccacttaattaatactgctccatgaagccagaatttggacatatggaaggtcttgcatttttcaccaaagaaaaagcactggtaaatgaggtttgttcagaattcatcaggaaacctattacaattgcagcagccctggaaacgcctgcattacaatgaacaagaaccactccatcctacaaaa

SEQ ID NO: 288039 - DNA, 3070 bp, Homo sapiens
gcaccccgcccctgcggccgcctctcgcggctcccggggtccccagctccctgtccccggagccagagcccggctcccgcgcggctcccagccccgccgcgccgccccccgcatgctaatggccgggccgcctcccgccgcacacaatgcgggccagggccgggggcgggggaccggggagggggcgggggccgggccgggggcgggggggccggggcccggcgcatctcccccggccccacgtaacgctgacgcccgcgccgccggcccgccgcccgccgccgccgccgccgccgccgcccgctccgccgccgcccgcccggggctcctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggcccacggggctcccgagcgtcccctggcggccacctccgctgcgcctccgcctcagcctcagcctcagcctccaccccagcccgaacccagatcagtcccccagccggagccggagccggagcccgaacgtgaggcaaccccgaccccagctcctgccgctcccgaggagcccccagcgcctccggagttccgctgccaagtgtgcggccagagctttacacagtcttggtttctcaagggccacatgcgtaagcacaaggcctccttcgatcatgcgtgtccggtgtgcggccgctgcttcaaggagccctggttccttaagaaccacatgaaggtgcacgccagcaagctgggcccactgcgtgccccggggcctgcctccgggcctgcccgcgccccccagcctcctgacctcggcctgctggcctatgagccgttgggcccagcgctcctcttggccccggctcccaccccggccgagcgccgtgagcccccgagcctcttgggctacctgagcctgcgagctggcgagggccggcccaacggcgagggtgctgagcccggtcccggccgcagcttcggaggcttccgcccgctgtcctctgctctcccggcccgggctcgccggcaccgtgcggaggagcctgaggaagaagaggaggtggtggaggccgaggaggaaacctgggcccggggcaggtcgctgggctctctggcttccctgcacccgcgcccgggtgagggaccggggcactctgcctctgctgctggggcccaggcaagatcgaccgccacgcaggaagagaatgggctgttggttggagggacccggcctgaagggggccggggcgccaccggcaaggattgtcctttctgcggaaaatctttccgctcagcacatcacctcaaagtgcatctgcgagtgcacacaggcgagcggccctacaagtgtccgcactgcgactacgcgggcacccagtccggctcgctcaagtatcacctacagcgccaccaccgggagcagaggagcggggccggccccgggccacccccggagccaccgcctccttcccagcggggttcggccccgcaatctggagccaagccgtctccgcagcctgcgacctgggtggagggcgcctcaagtccccggcctccttctagcggtgctgggccggggtcccgtcggaagcccgccagccctgggaggaccctgcgcaacgggcgaggcggtgaggccgaacccctggacctgtccttgcgggcagggccgggaggcgaggccgggcctgggggtgccctccaccgctgcctcttctgcccgttcgccactggagccccagagctcatggccttgcaccttcaagtgcaccacagccgccgggctaggggccgccggccaccccaggctgacgcgtccccgccctatgcccgagtaccatcaggagagacccctcccagtccttcgcaggaaggggaggagggctccgggctgtccagacccggagaggcagggctgggggggcaagaacggtagtgggccctcaggggcgattagcttagtgagcttaccccgccggagcgggggagcgctagaggtagttgggtagagaagccagcagggggcagcgtgggacccatatcccagccccaggcggaccagaggtggaaggcgcggcgggcgtaggagggtgggctggcggtacccacccagcccaagggagtcacagtgccttagaagtggcagaggtgagggtcaaagaacggggtccctgggctggcagagaaggtttgtgtccctgttgaggagccactctgccagtctttgctggtccataggcgtgagagtttatttttgtacaaggggtgagggtggggggcactgtacccttctagccccatcaggggccctgtagacgtcgctatttttggtacgattcctgtcatccctattgcagagtcgtgtccccaataaacaggtgtcttgaggcacagggccctgtgtctgtctgcctacctatgtcctg

SEQ ID NO: 288040 - DNA, 2191 bp, Homo sapiens
gcaccccgcccctgcggccgcctctcgcggctcccggggtccccagctccctgtccccggagccagagcccggctcccgcgcggctcccagccccgccgcgccgccccccgcatgctaatggccgggccgcctcccgccgcacacaatgcgggccagggccgggggcgggggaccggggagggggcgggggccgggccgggggcgggggggccggggcccggcgcatctcccccggccccacgtaacgctgacgcccgcgccgccggcccgccgcccgccgccgccgccgccgccgccgcccgctccgccgccgcccgcccggggctcctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggcccacggggctcccgagcgtcccctggcggccacctccgctgcgcctccgcctcagcctcagcctcagcctccaccccagcccgaacccagatcagtcccccagccggagccggagccggagcccgaacgtgaggcaaccccgaccccagctcctgccgctcccgaggagcccccagcgcctccggagttccgctgccaagtgtgcggccagagctttacacagtcttggtttctcaagggccacatgcgtaagcacaaggcctccttcgatcatgcgtgtccggtgtgcggccgctgcttcaaggagccctggttccttaagaaccacatgaaggtgcacgccagcaagctgggcccactgcgtgccccggggcctgcctccgggcctgcccgcgccccccagcctcctgacctcggcctgctggcctatgagccgttgggcccagcgctcctcttggccccggctcccaccccggccgagcgccgtgagcccccgagcctcttgggctacctgagcctgcgagctggcgagggccggcccaacggcgagggtgctgagcccggtcccggccgcagcttcggaggcttccgcccgctgtcctctgctctcccggcccgggctcgccggcaccgtgcggaggagcctgaggaagaagaggaggtggtggaggccgaggaggaaacctgggcccggggcaggtcgctgggctctctggcttccctgcacccgcgcccgggtgagggaccggggcactctgcctctgctgctggggcccaggcaagatcgaccgccacgcaggaagagaatgggctgttggttggagggacccggcctgaagggggccggggcgccaccggcaaggattgtcctttctgcggaaaatctttccgctcagcacatcacctcaaagtgcatctgcgagtgcacacaggcgagcggccctacaagtgtccgcactgcgactacgcgggcacccagtccggctcgctcaagtatcacctacagcgccgctcccgaggagcccccagcgcctccggagttccgctgccaagtgtgcggccagagctttacacagtcttggtttctcaagggccacatgcgtaagcacaaggcctccttcgatcatgcgtgtccggtgtgcggccgc

SEQ ID NO: 288041 - DNA, 2135 bp, Homo sapiens
gcaccccgcccctgcggccgcctctcgcggctcccggggtccccagctccctgtccccggagccagagcccggctcccgcgcggctcccagccccgccgcgccgccccccgcatgctaatggccgggccgcctcccgccgcacacaatgcgggccagggccgggggcgggggaccggggagggggcgggggccgggccgggggcgggggggccggggcccggcgcatctcccccggccccacgtaacgctgacgcccgcgccgccggcccgccgcccgccgccgccgccgccgccgccgcccgctccgccgccgcccgcccggggctcctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggcccacggggctcccgagcgtcccctggcggccacctccgctgcgcctccgcctcagcctcagcctcagcctccaccccagcccgaacccagatcagtcccccagccggagccggagccggagcccgaacgtgaggcaaccccgaccccagctcctgccgctcccgaggagcccccagcgcctccggagttccgctgccaagtgtgcggccagagctttacacagtcttggtttctcaagggccacatgcgtaagcacaaggcctccttcgatcatgcgtgtccggtgtgcggccgctgcttcaaggagccctggttccttaagaaccacatgaaggtgcacgccagcaagctgggcccactgcgtgccccggggcctgcctccgggcctgcccgcgccccccagcctcctgacctcggccttgcaccttcaagtgcaccacagccgccgggctaggggccgccggccaccccaggctgacgcgtccccgccctatgcccgagtaccatcaggagagacccctcccagtccttcgcaggaaggggaggagggctccgggctgtccagacccggagaggcagggctgggggggcaagaacggtagtgggccctcaggggcgattagcttagtgagcttaccccgccggagcgggggagcgctagaggtagttgggtagagaagccagcagggggcagcgtgggacccatatcccagccccaggcggaccagaggtggaaggcgcggcgggcgtaggagggtgggctggcggtacccacccagcccaagggagtcacagtgccttagaagtggcagaggtgagggtcaaagaacggggtccctgggctggcagagaaggtttgtgtccctgttgaggagccactctgccagtctttgctggtccataggcgtgagagtttatttttgtacaaggggtgagggtggggggcactgtacccttctagccccatcaggggccctgtagacgtcgctatttttggtacgattcctgtcatccctattgcagagtcgtgtccccaataaacaggtgtcttgaggcacagggccctgtgtctgtctgcctacctatgtcctg

SEQ ID NO: 288042 - DNA, 339 bp, Homo sapiens
ctttactgctgaaaactagggctcatcttttcctccaaatctgtctcttgctttagctccacagcacctgttgccttcattagcagcttttcctcctcttccctgcacttcccagaaccaaagaatgtgaagggggtccatggaggtgagtgaagctctggcttcaacctacaagtacctacaactgtatactccctctcctgcctacctctctctctctttgacctcccattattagaagttaactccttggccctgacatctcgattcccatacacctccccccaccccatcttcccgaggtgagtagcaccctgtgttcctagttcaggccccagc

SEQ ID NO: 288043 - DNA, 2869 bp, Homo sapiens
gcaccccgcccctgcggccgcctctcgcggctcccggggtccccagctccctgtccccggagccagagcccggctcccgcgcggctcccagccccgccgcgccgccccccgcatgctaatggccgggccgcctcccgccgcacacaatgcgggccagggccgggggcgggggaccggggagggggcgggggccgggccgggggcgggggggccggggcccggcgcatctcccccggccccacgtaacgctgacgcccgcgccgccggcccgccgcccgccgccgccgccgccgccgccgcccgctccgccgccgcccgcccggggctcctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagctgccaagtgtgcggccagagctttacacagtcttggtttctcaagggccacatgcgtaagcacaaggcctccttcgatcatgcgtgtccggtgtgcggccgctgcttcaaggagccctggttccttaagaaccacatgaaggtgcacgccagcaagctgggcccactgcgtgccccggggcctgcctccgggcctgcccgcgccccccagcctcctgacctcggcctgctggcctatgagccgttgggcccagcgctcctcttggccccggctcccaccccggccgagcgccgtgagcccccgagcctcttgggctacctgagcctgcgagctggcgagggccggcccaacggcgagggtgctgagcccggtcccggccgcagcttcggaggcttccgcccgctgtcctctgctctcccggcccgggctcgccggcaccgtgcggaggagcctgaggaagaagaggaggtggtggaggccgaggaggaaacctgggcccggggcaggtcgctgggctctctggcttccctgcacccgcgcccgggtgagggaccggggcactctgcctctgctgctggggcccaggcaagatcgaccgccacgcaggaagagaatgggctgttggttggagggacccggcctgaagggggccggggcgccaccggcaaggattgtcctttctgcggaaaatctttccgctcagcacatcacctcaaagtgcatctgcgagtgcacacaggcgagcggccctacaagtgtccgcactgcgactacgcgggcacccagtccggctcgctcaagtatcacctacagcgccaccaccgggagcagaggagcggggccggccccgggccacccccggagccaccgcctccttcccagcggggttcggccccgcaatctggagccaagccgtctccgcagcctgcgacctgggtggagggcgcctcaagtccccggcctccttctagcggtgctgggccggggtcccgtcggaagcccgccagccctgggaggaccctgcgcaacgggcgaggcggtgaggccgaacccctggacctgtccttgcgggcagggccgggaggcgaggccgggcctgggggtgccctccaccgctgcctcttctgcccgttcgccactggagccccagagctcatggccttgcaccttcaagtgcaccacagccgccgggctaggggccgccggccaccccaggctgacgcgtccccgccctatgcccgagtaccatcaggagagacccctcccagtccttcgcaggaaggggaggagggctccgggctgtccagacccggagaggcagggctgggggggcaagaacggtagtgggccctcaggggcgattagcttagtgagcttaccccgccggagcgggggagcgctagaggtagttgggtagagaagccagcagggggcagcgtgggacccatatcccagccccaggcggaccagaggtggaaggcgcggcgggcgtaggagggtgggctggcggtacccacccagcccaagggagtcacagtgccttagaagtggcagaggtgagggtcaaagaacggggtccctgggctggcagagaaggtttgtgtccctgttgaggagccactctgccagtctttgctggtccataggcgtgagagtttatttttgtacaaggggtgagggtggggggcactgtacccttctagccccatcaggggccctgtagacgtcgctatttttggtacgattcctgtcatccctattgcagagtcgtgtccccaataaacaggtgtcttgaggcacagggccctgtgtctgtctgcctacctatgtcctg

SEQ ID NO: 288044 - DNA, 5145 bp, Homo sapiens
  misc_feature (1094)..(1095): n is a, c, g, or t
acccgaaggtgcctgggaggcgggaggggggttggggcttctcagcgccgattccgcgggaagggccctgggacctcacacttctagtcgcgggagctgcaggtcttacccggagagacgctgcacgtggagccctcgccgctgccgttctcagccggctctggagtgcgggcgggggcgacagggccgattccggagtgggactgatcctttgaaatactccagccatgactaaaagagaagcagaggagctgatagaaattgagattgatggaacagagaaagcagagtgcacagaagaaagcattgtagaacaaacctacgcgccagctgaatgtgtaagccaggccatagacatcaatgaaccaataggcaatttaaagaaactgctagaaccaagactacagtgttctttggatgctcatgaaatttgtctgcaagatatccagctggatccagaacgaagtttatttgaccaaggagtaaaaacagatggaactgtacagcttagtgtacaggtaatttcttaccaaggaattgaaccaaagttaaacatccttgaaattgttaaacctgcggacactgttgaggttgttattgatccagatgcccaccatgctgaatcagaagcacatcttgttgaagaagctcaagtgataactcttgatggcacaaaacacatcacaaccatttcagatgaaacttcagaacaagtgacaagatgggctgctgcactggaaggctataggaaagaacaagaacgccttgggataccctatgatcccatacagtggtccacagaccaagtcctgcattgggtggtttgggtaatgaaggaattcagcatgaccgatatagacctcaccacactcaacatttcggggagagaattatgtagtctcaaccaagaagatttttttcagcgggttcctcggggagaaattctctggagtcatctggaacttctccgaaaatatgtattggcaagtcaagaacaacagatgaatgaaatagttacaattgatcaacctgtgcaaattattccagcatcagtgcaatctgctacacctactaccattaaagttataaatagnngtgcgaaagcagccaaagtacaaagagcgccgaggatttcaggagaagatagaagctcacctgggaacagaacaggaaacaatggccaaatccaactatggcagtttttgctagaacttcttactgataaggacgctcgagactgcatttcttgggttggtgatgaaggtgaatttaagctaaatcagcctgaactggttgcacagaaatggggacagcgtaaaaataagcctacgatgaactatgagaaactcagtcgtgcattaagatattattacgatggggacatgatttgtaaagttcaaggcaagagatttgtgtacaagtttgtctgtgacttgaagactcttattggatacagtgcagcggagttgaaccgtttggtcacagaatgtgaacagaagaaacttgcaaagatgcagctccatggaattgcccagccagtcacagcagtagctctggctactgcttctctgcaaacggaaaaggataattgagccccaggacattctgagactccaaagtctttcttaaaatgtttagagcaagtatagctcttacctttattactgaatttgaatcttcttttatttctaggctgtacagtctgatgcatgatttttttataaatatttcatactcttgtgaatttggatctttttactttgagcatatattttagaatatgtgtatgttaaaggatctccacaatgtctgcagtgtgaaggcaggttcattgtggaatagtttaacagtcaggaaggctaaactggtcagtattaatgtgtagccctaccaaaaatagccagtagtatctgaaaatgaaaaataaatgaagtatctctaggaaacagtctggcttaactatttttgaaaatataactgtttcccctctctgctgctttagatgttgctttacatagaaccagaaaatggaatttctcagctaaagcatgtgtgcctgtttcatctaatcaagcagagctaaaatgttcataccgaataaatttatattaataaattactaaactaagagtatcaggttatttatatatttgcaagcaaaggacagtaagaagttgactggcaaaagagcagtgctgaaggaggagatccaggtttaaatctggcttattaactcaagccaattttaaggattttctgtatagattactcatgtcagaccaagaatttaaattattttgagagaggcatttaattctaataaaccagctgttataaaaattataaaatgatctctgtttttcctgtcagagatttaaaaaactgaaaaggtatacctcaacccaaaaataaaggtttgttttggtttgttatggcttccttttttaaaaaattaccctgtagtgccagtttattatgcaaagcagcttatattcctttgtttctgataaaatgaagactttaaatcagtcagtagtactttacctttcaaggcattagtaaattacttgcaaatagttttaaaaggaaaatacgacctttgttataggcagtcttctctttaagacaatacttttccacttgttttccttttccatattatatatgtgtattcatatagctgtatacatattcagttgatcattttataaacatatgaaggcataaagatatacagaagaaaaattattaaacaactcattttaagattcaaattaactaattcctgcatatatgacattccttacataagcgaacactaaacaaaaatggctagaaatgtctttttctttcttttctctctttgttgtttaaggtattaagcacgaattattacatgagactggcagatagctattaatcctcttacagatttgagaaagttgattctcaaatatttatgcaccttctccttcattgttttctttaaatctgtcctcttaaaaagcttcttaagagctcagttaatgcttttgacttaactaggagaaaaaggcatgataatacaggcaagatggcattgttagcaattctggtagtggtttggaatgaatcctaagaggcagggatcttaaggacaaggaagagaagagagagagggagggatctttgatctctttctctggtaatcttaatgcataattttactaaaacatgttctcaattcattcatattattaagctcttcctgcagttgatatctgagcagagtaagatttgtatttccatttttacttttttgaaagagaatatatggacagattattagtacaatttgggcactgtggttttaagaatatctgagtaaaataacaatatgaaataataaacagaagctctaacgtcaggtaacaaatagacagcaagaaaggttttgcaccatcctcttacggcctagagagttgacaagttgcttgtagttttaaaaaaataataaagtatacccttctggtatatcatcaagagcttaagaatcttggctttcatatttaaaatgcttttggggagacatatattaaaattttagccaagatgatagacatgtctcaattatatatgtgtgtgtatgtttttaaagctaaaaacattacttttagatccctagaatgaaaatttttttctcatctatgcaattcccatatggttttttttaaatcatattttattcattttctccctttagcaattttcattttatttctcataatttgaacagagacagttctcatacatgatcagatgctttttttttcttcttaccatcatttatgcatgacataggtaatgtgactaatttctccagttgattcaagaaactcattactttgcctcaaattatatgtaaaatatttgttttacttaggttacagttatcagaaaggtagtttttttcttctattaaaatataacattgtgaaagaaaataaaatttatgctattctttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaactttcatacatatcttgctagcctaaagtctaaatatttgtgttggcatcagaaaaacaaatgaggcagaattgctatgtgtggttgatcttcagataaattgactgatcacagttatttttgtatcagtctatgttattaggaaaaattgtttagttgttttctcccctgattaatggtgatattcaagtatgatacaaaaagaattgtaccaccaaatatttttgtgaggtctgctgttttccatattcattttatgctactgcctttaagaaagaactagtgtatccttgaaatagcacaaaaatgttttaaaattcataattgcaaaacaaatctgtgactaacttaatgtcttcagatctaaagggtgtaaaaatattgatacttcaatatttcacttgctgccaggaaaaacaaaattctcaatcttttgtaaatgggaggaggacttttgcatacatttttactctttaaataacgacaacgacacttatactgtcataataacaattatgtatttctttgtggttttaattttttttgtaattttacataaaacagttattttctatttttacgcagataaatatttgtgcataaaatgtaaaaatagtaaaatgagaaaaataaaactattatacagtaaaaaaaaaaaaaaaaaaaaaaaaaaacacaacaacaaaaaaacaaaaaaaaaaacccaggcccccccccccacaaagcacaacgatcggcacaacccgcaaacccctcagagaacggaggcgccacgcgaggcgagcacaccgaaaccgtacaactaaaacacgacgacaacacagacagacgatctctaacacagcgcacaacgacaagagcaacccaaacaagcaccgcgacagacaacacgtcacatcgctccacggacaacgagcccaccaccgaagtaacaaagacacacaacgaaaacaaacaagcgcacaaacaaaacc

SEQ ID NO: 288045 - DNA, 5091 bp, Homo sapiens
  misc_feature (1094)..(1095): n is a, c, g, or t
acccgaaggtgcctgggaggcgggaggggggttggggcttctcagcgccgattccgcgggaagggccctgggacctcacacttctagtcgcgggagctgcaggtcttacccggagagacgctgcacgtggagccctcgccgctgccgttctcagccggctctggagtgcgggcgggggcgacagggccgattccggagtgggactgatcctttgaaatactccagccatgactaaaagagaagcagaggagctgatagaaattgagattgatggaacagagaaagcagagtgcacagaagaaagcattgtagaacaaacctacgcgccagctgaatgtgtaagccaggccatagacatcaatgaaccaataggcaatttaaagaaactgctagaaccaagactacagtgttctttggatgctcatgaaatttgtctgcaagatatccagctggatccagaacgaagtttatttgaccaaggagtaaaaacagatggaactgtacagcttagtgtacaggtaatttcttaccaaggaattgaaccaaagttaaacatccttgaaattgttaaacctgcggacactgttgaggttgttattgatccagatgcccaccatgctgaatcagaagcacatcttgttgaagaagctcaagtgataactcttgatggcacaaaacacatcacaaccatttcagatgaaacttcagaacaagtgacaagatgggctgctgcactggaaggctataggaaagaacaagaacgccttgggataccctatgatcccatacagtggtccacagaccaagtcctgcattgggtggtttgggtaatgaaggaattcagcatgaccgatatagacctcaccacactcaacatttcggggagagaattatgtagtctcaaccaagaagatttttttcagcgggttcctcggggagaaattctctggagtcatctggaacttctccgaaaatatgtattggcaagtcaagaacaacagatgaatgaaatagttacaattgatcaacctgtgcaaattattccagcatcagtgcaatctgctacacctactaccattaaagttataaatagnngtgcgaaagcagccaaagtacaaagagcgccgaggatttcaggagaagatagaagctcacctgggaacagaacaggaaacaatggccaaatccaactatggcagtttttgctagaacttcttactgataaggacgctcgagactgcatttcttgggttggtgatgaaggtgaatttaagctaaatcagcctgaactggttgcacagaaatggggacagcgtaaaaataagcctacgatgaactatgagaaactcagtcgtgcattaagatattattacgatggggacatgatttgtaaagttcaaggcaagagatttgtgtacaagtttgtctgtgacttgaagactcttattggatacagtgcagcggagttgaaccgtttggtcacagaatgtgaacagaagaaacttgcaaagatgcagctccatggaattgcccagccagtcacagcagtagctctggctactgcttctctgcaaacggaaaaggataattgagccccaggacattctgagactccaaagtctttcttaaaatgtttagagcaagtatagctcttacctttattactgaatttgaatcttcttttatttctaggctgtacagtctgatgcatgatttttttataaatatttcatactcttgtgaatttggatctttttactttgagcatatattttagaatatgtgtatgttaaaggatctccacaatgtctgcagtgtgaaggcaggttcattgtggaatagtttaacagtcaggaaggctaaactggtcagtattaatgtgtagccctaccaaaaatagccagtagtatctgaaaatgaaaaataaatgaagtatctctaggaaacagtctggcttaactatttttgaaaatataactgtttcccctctctgctgctttagatgttgctttacatagaaccagaaaatggaatttctcagctaaagcatgtgtgcctgtttcatctaatcaagcagagctaaaatgttcataccgaataaatttatattaataaattactaaactaagagtatcaggttatttatatatttgcaagcaaaggacagtaagaagttgactggcaaaagagcagtgctgaaggaggagatccaggtttaaatctggcttattaactcaagccaattttaaggattttctgtatagattactcatgtcagaccaagaatttaaattattttgagagaggcatttaattctaataaaccagctgttataaaaattataaaatgatctctgtttttcctgtcagagatttaaaaaactgaaaaggtatacctcaacccaaaaataaaggtttgttttggtttgttatggcttccttttttaaaaaattaccctgtagtgccagtttattatgcaaagcagcttatattcctttgtttctgataaaatgaagactttaaatcagtcagtagtactttacctttcaaggcattagtaaattacttgcaaatagttttaaaaggaaaatacgacctttgttataggcagtcttctctttaagacaatacttttccacttgttttccttttccatattatatatgtgtattcatatagctgtatacatattcagttgatcattttataaacatatgaaggcataaagatatacagaagaaaaattattaaacaactcattttaagattcaaattaactaattcctgcatatatgacattccttacataagcgaacactaaacaaaaatggctagaaatgtctttttctttcttttctctctttgttgtttaaggtattaagcacgaattattacatgagactggcagatagctattaatcctcttacagatttgagaaagttgattctcaaatatttatgcaccttctccttcattgttttctttaaatctgtcctcttaaaaagcttcttaagagctcagttaatgcttttgacttaactaggagaaaaaggcatgataatacaggcaagatggcattgttagcaattctggtagtggtttggaatgaatcctaagaggcagggatcttaaggacaaggaagagaagagagagagggagggatctttgatctctttctctggtaatcttaatgcataattttactgagcagagtaagatttgtatttccatttttacttttttgaaagagaatatatggacagattattagtacaatttgggcactgtggttttaagaatatctgagtaaaataacaatatgaaataataaacagaagctctaacgtcaggtaacaaatagacagcaagaaaggttttgcaccatcctcttacggcctagagagttgacaagttgcttgtagttttaaaaaaataataaagtatacccttctggtatatcatcaagagcttaagaatcttggctttcatatttaaaatgcttttggggagacatatattaaaattttagccaagatgatagacatgtctcaattatatatgtgtgtgtatgtttttaaagctaaaaacattacttttagatccctagaatgaaaatttttttctcatctatgcaattcccatatggttttttttaaatcatattttattcattttctccctttagcaattttcattttatttctcataatttgaacagagacagttctcatacatgatcagatgctttttttttcttcttaccatcatttatgcatgacataggtaatgtgactaatttctccagttgattcaagaaactcattactttgcctcaaattatatgtaaaatatttgttttacttaggttacagttatcagaaaggtagtttttttcttctattaaaatataacattgtgaaagaaaataaaatttatgctattctttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaactttcatacatatcttgctagcctaaagtctaaatatttgtgttggcatcagaaaaacaaatgaggcagaattgctatgtgtggttgatcttcagataaattgactgatcacagttatttttgtatcagtctatgttattaggaaaaattgtttagttgttttctcccctgattaatggtgatattcaagtatgatacaaaaagaattgtaccaccaaatatttttgtgaggtctgctgttttccatattcattttatgctactgcctttaagaaagaactagtgtatccttgaaatagcacaaaaatgttttaaaattcataattgcaaaacaaatctgtgactaacttaatgtcttcagatctaaagggtgtaaaaatattgatacttcaatatttcacttgctgccaggaaaaacaaaattctcaatcttttgtaaatgggaggaggacttttgcatacatttttactctttaaataacgacaacgacacttatactgtcataataacaattatgtatttctttgtggttttaattttttttgtaattttacataaaacagttattttctatttttacgcagataaatatttgtgcataaaatgtaaaaatagtaaaatgagaaaaataaaactattatacagtaaaaaaaaaaaaaaaaaaaaaaaaaaacacaacaacaaaaaaacaaaaaaaaaaacccaggcccccccccccacaaagcacaacgatcggcacaacccgcaaacccctcagagaacggaggcgccacgcgaggcgagcacaccgaaaccgtacaactaaaacacgacgacaacacagacagacgatctctaacacagcgcacaacgacaagagcaacccaaacaagcaccgcgacagacaacacgtcacatcgctccacggacaacgagcccaccaccgaagtaacaaagacacacaacgaaaacaaacaagcgcacaaacaaaacc

SEQ ID NO: 288046 - DNA, 4819 bp, Homo sapiens
  misc_feature (1094)..(1095): n is a, c, g, or t
acccgaaggtgcctgggaggcgggaggggggttggggcttctcagcgccgattccgcgggaagggccctgggacctcacacttctagtcgcgggagctgcaggtcttacccggagagacgctgcacgtggagccctcgccgctgccgttctcagccggctctggagtgcgggcgggggcgacagggccgattccggagtgggactgatcctttgaaatactccagccatgactaaaagagaagcagaggagctgatagaaattgagattgatggaacagagaaagcagagtgcacagaagaaagcattgtagaacaaacctacgcgccagctgaatgtgtaagccaggccatagacatcaatgaaccaataggcaatttaaagaaactgctagaaccaagactacagtgttctttggatgctcatgaaatttgtctgcaagatatccagctggatccagaacgaagtttatttgaccaaggagtaaaaacagatggaactgtacagcttagtgtacaggtaatttcttaccaaggaattgaaccaaagttaaacatccttgaaattgttaaacctgcggacactgttgaggttgttattgatccagatgcccaccatgctgaatcagaagcacatcttgttgaagaagctcaagtgataactcttgatggcacaaaacacatcacaaccatttcagatgaaacttcagaacaagtgacaagatgggctgctgcactggaaggctataggaaagaacaagaacgccttgggataccctatgatcccatacagtggtccacagaccaagtcctgcattgggtggtttgggtaatgaaggaattcagcatgaccgatatagacctcaccacactcaacatttcggggagagaattatgtagtctcaaccaagaagatttttttcagcgggttcctcggggagaaattctctggagtcatctggaacttctccgaaaatatgtattggcaagtcaagaacaacagatgaatgaaatagttacaattgatcaacctgtgcaaattattccagcatcagtgcaatctgctacacctactaccattaaagttataaatagnngtgcgaaagcagccaaagtacaaagagcgccgaggatttcaggagaagatagaagctcacctgggaacagaacaggaaacaatggccaaatccaactatggcagtttttgctagaacttcttactgataaggacgctcgagactgcatttcttgggttggtgatgaaggtgaatttaagctaaatcagcctgaactggttgcacagaaatggggacagcgtaaaaataagcctacgatgaactatgagaaactcagtcgtgcattaagatattattacgatggggacatgatttgtaaagttcaaggcaagagatttgtgtacaagtttgtctgtgacttgaagactcttattggatacagtgcagcggagttgaaccgtttggtcacagaatgtgaacagaagaaacttgcaaagatgcagctccatggaattgcccagccagtcacagcagtagctctggctactgcttctctgcaaacggaaaaggataattgagccccaggacattctgagactccaaagtctttcttaaaatgtttagagcaagtatagctcttacctttattactgaatttgaatcttcttttatttctaggctgtacagtctgatgcatgatttttttataaatatttcatactcttgtgaatttggatctttttactttgagcatatattttagaatatgtgtatgttaaaggatctccacaatgtctgcagtgtgaaggcaggttcattgtggaatagtttaacagtcaggaaggctaaactggtcagtattaatgtgtagccctaccaaaaatagccagtagtatctgaaaatgaaaaataaatgaagtatctctaggaaacagtctggcttaactatttttgaaaatataactgtttcccctctctgctgctttagatgttgctttacatagaaccagaaaatggaatttctcagctaaagcatgtgtgcctgtttcatctaatcaagcagagctaaaatgttcataccgaataaatttatattaataaattactaaactaagagtatcaggttatttatatatttgcaagcaaaggacagtaagaagttgactggcaaaagagcagtgctgaaggaggagatccaggtttaaatctggcttattaactcaagccaattttaaggattttctgtatagattactcatgtcagaccaagaatttaaattattttgagagaggcatttaattctaataaaccagctgttataaaaattataaaatgatctctgtttttcctgtcagagatttaaaaaactgaaaaggtatacctcaacccaaaaataaaggtttgttttggtttgttatggcttccttttttaaaaaattaccctgtagtgccagtttattatgcaaagcagcttatattcctttgtttctgataaaatgaagactttaaatcagtcagtagtactttacctttcaaggcattagtaaattacttgcaaatagttttaaaaggaaaatacgacctttgttataggcagtcttctctttaagacaatacttttccacttgttttccttttccatattatatatgtgtattcatatagctgtatacatattcagttgatcattttataaacatatgaaggcataaagatatacagaagaaaaattattaaacaactcattttaagattcaaattaactaattcctgcatatatgacattccttacataagcgaacactaaacaaaaatggctagaaatgtctttttctttcttttctctctttgttgtttaaggtattaagcacgaattattacatgagactggcagatagctattaatcctcttacagatttgagaaagttgattctcaaatatttatgcaccttctccttcattgttttctttaaatctgtcctcttaaaaagcttcttaagagctcagttaatgcttttgacttaactaggagaaaaaggcatgataatacaggcaagatggcattgttagcaattctggtagtggtttggaatgaatcctaagaggcagggatcttaaggacaaggaagagaagagagagagggagggatctttgatctctttctctggtaatcttaatgcataattttactaaaacatgttctcaattcattcatattattaagctcttcctgcagttgatatctgagcagagtaagatttgtatttccatttttacttttttgaaagagaatatatggacagattattagtacaatttgggcactgtggttttaagaatatctgagtaaaataacaatatgaaataataaacagaagctctaacgtcaggtaacaaatagacagcaagaaaggttttgcaccatcctcttacggcctagagagttgacaagttgcttgtagttttaaaaaaataataaagtatacccttctggtatatcatcaagagcttaagaatcttggctttcatatttaaaatgcttttggggagacatatattaaaattttagccaagatgatagacatgtctcaattatatatgtgtgtgtatgtttttaaagctaaaaacattacttttagatccctagaatgaaaatttttttctcatctatgcaattcccatatggttttttttaaatcatattttattcattttctccctttagcaattttcattttatttctcataatttgaacagagacagttctcatacatgatcagatgctttttttttcttcttaccatcatttatgcatgacataggtaatgtgactaatttctccagttgattcaagaaactcattactttgcctcaaattatatgtaaaatatttgttttacttaggttacagttatcagaaaggtagtttttttcttctattaaaatataacattgtgaaagaaaataaaatttatgctattctttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaactttcatacatatcttgctagcctaaagtctaaatatttgtgttggcatcagaaaaacaaatgaggcagaattgctatgtgtggttgatcttcagataaattgactgatcacagttatttttgtatcagtctatgttattaggaaaaattgtttagttgttttctcccctgattaatggtgatattcaagtatgatacaaaaagaattgtaccaccaaatatttttgtgaggtctgctgttttccatattcattttatgctactgcctttaagaaagaactagtgtatccttgaaatagcacaaaaatgttttaaaattcataattgcaaaacaaatctgtgactaacttaatgtcttcagatctaaagggtgtaaaaatattgatacttcaatatttcacttgctgccaggaaaaacaaaattctcaatcttttgtaaatgggaggaggacttttgcatacatttttactctttaaataacgacaacgacacttatactgtcataataacaattatgtatttctttgtggttttaattttttttgtaattttacataaaacagttattttctatttttacgcagataaatatttgtgcataaaatgtaaaaatagtaaaatgagaaaaataaaactattatacagta

SEQ ID NO: 288047 - DNA, 4858 bp, Homo sapiens
  misc_feature (1094)..(1095): n is a, c, g, or t
acccgaaggtgcctgggaggcgggaggggggttggggcttctcagcgccgattccgcgggaagggccctgggacctcacacttctagtcgcgggagctgcaggtcttacccggagagacgctgcacgtggagccctcgccgctgccgttctcagccggctctggagtgcgggcgggggcgacagggccgattccggagtgggactgatcctttgaaatactccagccatgactaaaagagaagcagaggagctgatagaaattgagattgatggaacagagaaagcagagtgcacagaagaaagcattgtagaacaaacctacgcgccagctgaatgtgtaagccaggccatagacatcaatgaaccaataggcaatttaaagaaactgctagaaccaagactacagtgttctttggatgctcatgaaatttgtctgcaagatatccagctggatccagaacgaagtttatttgaccaaggagtaaaaacagatggaactgtacagcttagtgtacaggtaatttcttaccaaggaattgaaccaaagttaaacatccttgaaattgttaaacctgcggacactgttgaggttgttattgatccagatgcccaccatgctgaatcagaagcacatcttgttgaagaagctcaagtgataactcttgatggcacaaaacacatcacaaccatttcagatgaaacttcagaacaagtgacaagatgggctgctgcactggaaggctataggaaagaacaagaacgccttgggataccctatgatcccatacagtggtccacagaccaagtcctgcattgggtggtttgggtaatgaaggaattcagcatgaccgatatagacctcaccacactcaacatttcggggagagaattatgtagtctcaaccaagaagatttttttcagcgggttcctcggggagaaattctctggagtcatctggaacttctccgaaaatatgtattggcaagtcaagaacaacagatgaatgaaatagttacaattgatcaacctgtgcaaattattccagcatcagtgcaatctgctacacctactaccattaaagttataaatagnngtgcgaaagcagccaaagtacaaagagcgccgaggatttcaggagaagatagaagctcacctgggaacagaacaggaaacaatggccaaatccaactatggcagtttttgctagaacttcttactgataaggacgctcgagactgcatttcttgggttggtgatgaaggtgaatttaagctaaatcagcctgaactggttgcacagaaatggggacagcgtaaaaataagcctacgatgaactatgagaaactcagtcgtgcattaagatattattacgatggggacatgatttgtaaagttcaaggcaagagatttgtgtacaagtttgtctgtgacttgaagactcttattggatacagtgcagcggagttgaaccgtttggtcacagaatgtgaacagaagaaacttgcaaagatgcagctccatggaattgcccagccagtcacagcagtagctctggctactgcttctctgcaaacggaaaaggataattgagccccaggacattctgagactccaaagtctttcttaaaatgtttagagcaagtatagctcttacctttattactgaatttgaatcttcttttatttctaggctgtacagtctgatgcatgatttttttataaatatttcatactcttgtgaatttggatctttttactttgagcatatattttagaatatgtgtatgttaaaggatctccacaatgtctgcagtgtgaaggcaggttcattgtggaatagtttaacagtcaggaaggctaaactggtcagtattaatgtgtagccctaccaaaaatagccagtagtatctgaaaatgaaaaataaatgaagtatctctaggaaacagtctggcttaactatttttgaaaatataactgtttcccctctctgctgctttagatgttgctttacatagaaccagaaaatggaatttctcagctaaagcatgtgtgcctgtttcatctaatcaagcagagctaaaatgttcataccgaataaatttatattaataaattactaaactaagagtatcaggttatttatatatttgcaagcaaaggacagtaagaagttgactggcaaaagagcagtgctgaaggaggagatccaggtttaaatctggcttattaactcaagccaattttaaggattttctgtatagattactcatgtcagaccaagaatttaaattattttgagagaggcatttaattctaataaaccagctgttataaaaattataaaatgatctctgtttttcctgtcagagatttaaaaaactgaaaaggtatacctcaacccaaaaataaaggtttgttttggtttgttatggcttccttttttaaaaaattaccctgtagtgccagtttattatgcaaagcagcttatattcctttgtttctgataaaatgaagactttaaatcagtcagtagtactttacctttcaaggcattagtaaattacttgcaaatagttttaaaaggaaaatacgacctttgttataggcagtcttctctttaagacaatacttttccacttgttttccttttccatattatatatgtgtattcatatagctgtatacatattcagttgatcattttataaacatatgaaggcataaagatatacagaagaaaaattattaaacaactcattttaagattcaaattaactaattcctgcatatatgacattccttacataagcgaacactaaacaaaaatggctagaaatgtctttttctttcttttctctctttgttgtttaaggtattaagcacgaattattacatgagactggcagatagctattaatcctcttacagatttgagaaagttgattctcaaatatttatgcaccttctccttcattgttttctttaaatctgtcctcttaaaaagcttcttaagagctcagttaatgcttttgacttaactaggagaaaaaggcatgataatacaggcaagatggcattgttagcaattctggtagtggtttggaatgaatcctaagaggcagggatcttaaggacaaggaagagaagagagagagggagggatctttgatctctttctctggtaatcttaatgcataattttactaaaacatgttctcaattcattcatattattaagctcttcctgcagttgatatctgagcagagtaagatttgtatttccatttttacttttttgaaagagaatatatggacagattattagtacaatttgggcactgtggttttaagaatatctgagtaaaataacaatatgaaataataaacagaagctctaacgtcaggtaacaaatagacagcaagaaaggttttgcaccatcctcttacggcctagagagttgacaagttgcttgtagttttaaaaaaataataaagtatacccttctggtatatcatcaagagcttaagaatcttggctttcatatttaaaatgcttttggggagacatatattaaaattttagccaagatgatagacatgtctcaattatatatgtgtgtgtatgtttttaaagctaaaaacattacttttagatccctagaatgaaaatttttttctcatctatgcaattcccatatggttttttttaaatcatattttattcattttctccctttagcaattttcattttatttctcataatttgaacagagacagttctcatacatgatcagatgctttttttttcttcttaccatcatttatgcatgacataggtaatgtgactaatttctccagttgattcaagaaactcattactttgcctcaaattatatgtaaaatatttgttttacttaggttacagttatcagaaaggtagtttttttcttctattaaaatataacattgtgaaagaaaataaaatttatgctattctttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaactttcatacatatcttgctagcctaaagtctaaatatttgtgttggcatcagaaaaacaaatgaggcagaattgctatgtgtggttgatcttcagataaattgactgatcacagttatttttgtatcagtctatgttattaggaaaaattgtttagttgttttctcccctgattaatggtgatattcaagtatgatacaaaaagaattgtaccaccaaatatttttgtgaggtctgctgttttccatattcattttatgctactgcctttaagaaagaactagtgtatccttgaaatagcacaaaaatgttttaaaattcataattgcaaaacaaatctgtgactaacttaatgtcttcagatctaaagggtgtaaaaatattgatacttcaatatttcacttgctgccaggaaaaacaaaattctcaatcttttgtaaatgggaggaggacttttgcatacatttttactctttaaataacgacaacgacacttatactgtcataataacaattatgtatttctttgtggttttaattttttttgtaattttacataaaacagttattttctatttttacgcagataaatatgggcctaccctgtccctccgtcccctgggaaattaaactattttccgccaacaaacacaacaacacacccccacacacacacagcgcgccaccc

SEQ ID NO: 288048 - DNA, 2592 bp, Homo sapiens
tcgaggacttagccattcagtttagtgttcgcttatgaaaggaatgtcatatatgcaggaattagttaatttgaatcttaaaatgagttgttttccttttccatattatatatgtgtattcatatagctgtatacatattcagttgatcattttataaacatatgaaggcataaagatatacagaagaaaaattattaaacaactcattttaagattcaaattaactaattcctgcatatatgacattccttacataagcgaacactaaacaaaaatggctagaaatgtctttttctttcttttctctctttgttgtttaaggtattaagcacgaattattacatgagactggcagatagctattaatcctcttacagatttgagaaagttgattctcaaatatttatgcaccttctccttcattgttttctttaaatctgtcctcttaaaaagcttcttaagagctcagttaatgcttttgacttaactaggagaaaaaggcatgataatacaggcaagatggcattgttagcaattctggtagtggtttggaatgaatcctaagaggcagggatcttaaggacaaggaagagaagagagagagggagggatctttgatctctttctctggtaatcttaatgcataattttactaaaacatgttctcaattcattcatattattaagctcttcctgcagttgatatctgagcagagtaagatttgtatttccatttttacttttttgaaagagaatatatggacagattattagtacaatttgggcactgtggttttaagaatatctgagtaaaataacaatatgaaataataaacagaagctctaacgtcaggtaacaaatagacagcaagaaaggttttgcaccatcctcttacggcctagagagttgacaagttgcttgtagttttaaaaaaataataaagtatacccttctggtatatcatcaagagcttaagaatcttggctttcatatttaaaatgcttttggggagacatatattaaaattttagccaagatgatagacatgtctcaattatatatgtgtgtgtatgtttttaaagctaaaaacattacttttagatccctagaatgaaaatttttttctcatctatgcaattcccatatggttttttttaaatcatattttattcattttctccctttagcaattttcattttatttctcataatttgaacagagacagttctcatacatgatcagatgctttttttttcttcttaccatcatttatgcatgacataggtaatgtgactaatttctccagttgattcaagaaactcattactttgcctcaaattatatgtaaaatatttgttttacttaggttacagttatcagaaaggtagtttttttcttctattaaaatataacattgtgaaagaaaataaaatttatgctattctttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaactttcatacatatcttgctagcctaaagtctaaatatttgtgttggcatcagaaaaacaaatgaggcagaattgctatgtgtggttgatcttcagataaattgactgatcacagttatttttgtatcagtctatgttattaggaaaaattgtttagttgttttctcccctgattaatggtgatattcaagtatgatacaaaaagaattgtaccaccaaatatttttgtgaggtctgctgttttccatattcattttatgctactgcctttaagaaagaactagtgtatccttgaaatagcacaaaaatgttttaaaattcataattgcaaaacaaatctgtgactaacttaatgtcttcagatctaaagggtgtaaaaatattgatacttcaatatttcacttgctgccaggaaaaacaaaattctcaatcttttgtaaatgggaggaggacttttgcatacatttttactctttaaataacgacaacgacacttatactgtcataataacaattatgtatttctttgtggttttaattttttttgtaattttacataaaacagttattttctatttttacgcagataaatatttgtgcataaaatgtaaaaatagtaaaatgagaaaaataaaactattatacagtaaaaaaaaaaaaaaaaaaaaaaaaaaacacaacaacaaaaaaacaaaaaaaaaaacccaggcccccccccccacaaagcacaacgatcggcacaacccgcaaacccctcagagaacggaggcgccacgcgaggcgagcacaccgaaaccgtacaactaaaacacgacgacaacacagacagacgatctctaacacagcgcacaacgacaagagcaacccaaacaagcaccgcgacagacaacacgtcacatcgctccacggacaacgagcccaccaccgaagtaacaaagacacacaacgaaaacaaacaagcgcacaaacaaaacc

SEQ ID NO: 288049 - DNA, 1169 bp, Homo sapiens
aattattggtcatcatttgtaccttagaagtacaagaattttatctttcttcctttgaatttacagtatattcaaaggaagaaagataaaattattggtcatcatttgtaccttagaagtacaagaatttaagtaaaagaaatgttcatttttgttttaaaatttgttttccatgtgaagtttttattgagccaactttcatacatatcttgctagcctaaagtctaaatatttgtgttggcatcagaaaaacaaatgaggcagaattgctatgtgtggttgatcttcagataaattgactgatcacagttatttttgtatcagtctatgttattaggaaaaattgtttagttgttttctcccctgattaatggtgatattcaagtatgatacaaaaagaattgtaccaccaaatatttttgtgaggtctgctgttttccatattcattttatgctactgcctttaagaaagaactagtgtatccttgaaatagcacaaaaatgttttaaaattcataattgcaaaacaaatctgtgactaacttaatgtcttcagatctaaagggtgtaaaaatattgatacttcaatatttcacttgctgccaggaaaaacaaaattctcaatcttttgtaaatgggaggaggacttttgcatacatttttactctttaaataacgacaacgacacttatactgtcataataacaattatgtatttctttgtggttttaattttttttgtaattttacataaaacagttattttctatttttacgcagataaatatttgtgcataaaatgtaaaaatagtaaaatgagaaaaataaaactattatacagtaaaaaaaaaaaaaaaaaaaaaaaaaaacacaacaacaaaaaaacaaaaaaaaaaacccaggcccccccccccacaaagcacaacgatcggcacaacccgcaaacccctcagagaacggaggcgccacgcgaggcgagcacaccgaaaccgtacaactaaaacacgacgacaacacagacagacgatctctaacacagcgcacaacgacaagagcaacccaaacaagcaccgcgacagacaacacgtcacatcgctccacggacaacgagcccaccaccgaagtaacaaagacacacaacgaaaacaaacaagcgcacaaacaaaacc

SEQ ID NO: 288050 - DNA, 404 bp, Homo sapiens
aatattaattgctattgtggcggatgcagtactctactaggcttctgcttatggaatagtctgtaaattattgtaagaagtctcattttttctgaagtctctaatttttttttctctttttgaagatattattacgatggggacatgatttgtaaagttcaaggcaagagatttgtgtacaagtttgtctgtgacttgaagactcttattggatacagtgcagcggagttgaaccgtttggtcacagaatgtgaacagaagaaacttgcaaagatgcagctccatggaattgcccagccagtcacagcagtagctctggctactgcttctctgcaaacggaaaaggataattgagccccaggacattctgagactccaaagtctttcttaaaatgtttagagca

SEQ ID NO: 288051 - DNA, 350 bp, Homo sapiens
gaaaaggtatacctcaacccaaaaataaaggtttgttttggtttgttatggcttccttttttaaaaaattaccctgtagtgccagtttattatgcaaagcagcttatattcctttgtttctgataaaatgaagactttaaatcagtcagtagtactttacctttcaaggcattagtaaattacttgcaaatagttttaaaaggaaaatacgacctttgttataggcagtcttctctttaagacaatacttttccacttgttttccttttccatattatatatgtgtattcatatagctgtatacatattcagttgatcattttataaacatatgaaggcataaagatata

SEQ ID NO: 288052 - DNA, 311 bp, Homo sapiens
gcaggtagaactgccaggtaggtgtactgactaatttcttttcttttgctactatctaaataacaaagcatgcttttccaactgcagataaacgaagaaaggaatcaggtaagtgagtgctggtttggcattttgtggtgtgagttgacagctactgtaaatcattatggctaagacttgattagtgctgcaaaaaatccataaaaatcttattttagtttgtttaaactttcttgtactttacttttcagcaaaactgctcattgaaagtcatctcattgaatcctaatgacctgtcagttaggtctagg

SEQ ID NO: 288053 - DNA, 635 bp, Homo sapiens
gcccaaccttcctctgcagcgccctaccgacccgcgctccgcagctcctgagggctttcgagcccagatggtcatctgagacgagaggtggcggcgaaggagagtctcgcctgtcacgctcccggagcaggggcttcatgaggtggccatggaaacagcctggcagactcccatctctcctggtgccatctccggagcggaaagtggagcgccccgctggcgaccaaggccgcactgagagccctggtttggtcaacagttgggctccaaggagccctggtattccttgaacatgcatacctttcccagcgtgagggacatggaccgtgccgtgcgagggaccccatcttctgcagcaggagggagcagagaagagaacacagggattcctgttgctaaaaggtctgttttctcctgctagccaccctcatcagccagagttcaaaccctgacagtgcccatggagagatctggtccaaggcaccaacctcttcctgctggactgagaaagagcctcctactgtgtctctctttacctcagcttttgcacacctccaatatattgtccactgaagtcagaataatctaaaaataaaggctgattacctcatgtggtataaacttaaaaaaaactc

SEQ ID NO: 288054 - DNA, 865 bp, Homo sapiens
aaaaaattgtaaccaccttggcagattgtggtgtaagcacaaaaagagttatcatttgcaaagaacgctgagctgccaacaccatgctgagggcagtgggacttcccagagtagtagaatacatgcagcctggtgtatattgagtttttgagcctatcactcagattctattctggaaatttcctctccttgttgaccctgcccccatttggtcaccctccctgccctaggactgagtacgaaggaaaggttattctactattctgtgctgggaggcagacatcgtcatacttaccaaggctgcttatgagatcttggagatacagaatggaaatgaccccacagtctctgggtaacaccctggagactgtattcaagctgcctgtagcaatatgaaggcttatgatcatttcatgttcatttaagggatgtatacatagttaaggaaaccatgagcaagaaaggagccctggtattccttgaacatgcatacctttcccagcgtgagggacatggaccgtgccgtgcgagggaccccatcttctgcagcaggagggagcagagaagagaacacaggttcagggtacatgtgcaggtgcattacataaacttgtcatgaagatttgttgtacagattatttcgtcacccagccaccctcatcagccagagttcaaaccctgacagtgcccatggagagatctggtccaaggcaccaacctcttcctgctggactgagaaagagcctcctactgtgtctctctttacctcagcttttgcacacctccaatatattgtccactgaagtcagaataatctaaaaataaaggctgattacctcatgtggtataaacttaaaaaaaactc

SEQ ID NO: 288055 - DNA, 874 bp, Homo sapiens
gcccaaccttcctctgcagcgccctaccgacccgcgctccgcagctcctgagggctttcgagcccagatggtcatctgagacgagaggtggcggcgaaggagagtctcgcctgtcacgctcccggagcaggggcttcatgaggtggccatggaaacagcctggcagactcccatctctcctggtgccatctccggagcggaaagtggagcgccccgctggcgaccaaggccgcactgagagccctggtttggtcaacagttgggctccaagaagtctcttcctttcactctgctgagtgaagcccttcctgccctcaggctggaccatggcttccatgctgcccctcttttcaaggctgcttgtctacagttctacaggtttctaggcccttggtgagtgaagagcagttcattacgaaatgacctccaagaacaaggctcagcattctctgaaatctcatgaagcagtgtaaccagctctcaagtatcttcctgtgaactagccacagggagccctggtattccttgaacatgcatacctttcccagcgtgagggacatggaccgtgccgtgcgagggaccccatcttctgcagcaggagggagcagagaagagaacacagggattcctgttgctaaaaggtctgttttctcctgctagccaccctcatcagccagagttcaaaccctgacagtgcccatggagagatctggtccaaggcaccaacctcttcctgctggactgagaaagagcctcctactgtgtctctctttacctcagcttttgcacacctccaatatattgtccactgaagtcagaataatctaaaaataaaggctgattacctcatgtggtataaacttaaaaaaaactc

SEQ ID NO: 288056 - DNA, 424 bp, Homo sapiens
gctgggagtttggccaggcagattcagggcattaaacttaggaaccacagcaacgctgaccctccggcgaggcatattctgcaggaagagaagtgaccaggctcactgtcttggaggtagcaatagccatagttcagaagggctgggaaaaagcctcctcatttctaatgctgtaatggcattcactggatattttggttttgcagtagcaatgatagaattggtgtggagagagtggccaaagttgacccaaattttctgttgttggtgagtgaacgctcaatctgttctattttagcttatgagatcttggagatacagaatggaaatgaccccacagtctctgggtaacaccctggagactgtattcaagctgcctgtagcaatatgaaggcttatgatcatttcatgttcatttaaggga

SEQ ID NO: 288057 - DNA, 597 bp, Homo sapiens
gcccaaccttcctctgcagcgccctaccgacccgcgctccgcagctcctgagggctttcgagcccagatggtcatctgagacgagaggtggcggcgaaggagagtctcgcctgtcacgctcccggagcaggggcttcatgaggtggccatggaaacagcctggcagactcccatctctcctggtgccatctccggagcggaaagtggagcgccccgctggcgaccaaggccgcactgagagccctggtttggtcaacagttgggctccaaggagccctggtattccttgaacatgcatacctttcccagcgtgagggacatggaccgtgccgtgcgagggaccccatcttctgcagcaggagggagcagagaagagaacacagccaccctcatcagccagagttcaaaccctgacagtgcccatggagagatctggtccaaggcaccaacctcttcctgctggactgagaaagagcctcctactgtgtctctctttacctcagcttttgcacacctccaatatattgtccactgaagtcagaataatctaaaaataaaggctgattacctcatgtggtataaacttaaaaaaaactc

SEQ ID NO: 288058 - DNA, 702 bp, Homo sapiens
cgcggagctcggagccagaagcagggacaagctccctcaaccgagccaacggtcctccgccacagacaaggggatgcgggaggaggaagggtgtgctctctgcccgcggtccggaggccccacgccccggtcccaagtccccggctgccgtctctccccgctccccacgtgacccggcccgggggactctggccgccctgctctcacctgtggggatgcccagctgcttggagccgcggccgaagccccgcaccacttgaccccggcagaagtaaggcaggtgcctcataatgcagtccgctcggggcatgggctgcggcccggtctgcgcgtcctgcggggccgccgtcgacgcggcgcccagaccccggaccagccgggggacaggagcgtgagctctgcctgccgcgggggcgcaccagtggccggacgacgccgaccacaggccactgcgaatccctgacgccgccgacccaacaaataccgccgggcgcctgaggagctgcgtctccgctggagggcagcggagacagccgaagccaggcttggtggctcacgcctgtattcccagtagtttgagaggccgacgcgggaggattgattgagcccaggaggtcgaggctgcactgagctatgataacgccactgcactccagactgggcgacacaatttctttaaagactcgtgcagcacatcattat

SEQ ID NO: 288059 - DNA, 1696 bp, Homo sapiens
cgcggagctcggagccagaagcagggacaagctccctcaaccgagccaacggtcctccgccacagacaaggggatgcgggaggaggaagggtgtgctctctgcccgcggtccggaggccccacgccccggtcccaagtccccggctgccgtctctccccgctccccacgtgacccggcccgggggactctggccgccctgctctcacctgtggggatgcccagctgcttggagccgcggccgaagccccgcaccacttgaccccggcagaagtaaggcaggtgcctcataatgcagtccgctcggggcatgggctgcggcccggtctgcgcgtcctgcggggccgccgtcgacgcggcgcccagaccccggaccagccgggggacaggagcgtgagctctgcctgccgcgggggcgcaccagtggccggacgacgccgaccacaggccactgcgaatccctgacgccgccgacccaacaaataccgccgggcgcctgaggagctgcgtctccgctggagggcagcggagacagccgaagccaggcttggtggctcacgcctgtattcccagtagtttgagaggccgacgcgggaggattgattgagcccaggaggtcgaggctgcactgagctatgataacgccactgcactccagactgggcgacacaaggggcccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctgtaaaaggaaaagtaatggcatctatatcataaatctgaagaggacctgggagaagcttctgctggcagctagtgctattgttgccattgaaaaaccctgctgagtgtcagtgttatatccctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccgtgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcacccactgactggtcttaagctgttcttgcataggctcttaagcagcatggaaaaatggttgatggaaaataaacatcagtttcttaaaaaaaaaaa

SEQ ID NO: 288060 - DNA, 1497 bp, Homo sapiens
ttaaattaaatgaggtcataagagtggggccctagtctgataggactggtgtccttacaagaagagggagagtcctcagagagtcctctctctcggcatggacacaaaagaaaagccatgtgaggacacagagagaaggtggctgtctacgagctaggaagaaaggcctcaccggaaaccaaccctcacagcagctccatcttggacttccagcctccggaactgtgagaaaataaatgtttgcaattcaggctcagagccactcagacattgggaagcaagtttgtcaagatgacagagaaccgaggtaatggattcgagtgatgaaacaggaagttcattcatgagtttttggccacacctccaaagtgacgacttagccagaaatgggataactgggtttccctacttctcttttatcatcctcaatgagagtgaccaaatattagagctagatggaaccttagtgaaaatctggctactcgtcccgtcccaccagcctgccacccatttcaagtttgaagagacaaagacacatggaccttatgtaattactggggattaccccaggagtctgtggcaaaagtcagtttcttccctccctgcttccccgccctgtctctggtactttctaccaacactgggctgtttctgtgatcacacttaagcgtacctaacctgcgaatgctgtatagaaggtgctaatgaacatgatttagctttaacactcagttttctaaagggacacgtgggggcagcaaatgtttaggcaaaaacaattcccagttctagcctctactgtctacatatgtgtatacatttgggaaacgtttgggaaagggatatttgagagcttctttttcttttttgtggtttagttatttgatgatattgagattgtttctgagccatgtgcttcaacatcggattggggatttcagaaaaagttttagtcactgtgattccatttagcttccaaatgtgtctctgctaagagacttaaaagcactcataaatagcacgtgtgtcttctttgcagtgtttgctaattttgagtcacatctttttagaaaatcatgagatttggtgtcacagagactggaataaatatagtcaaacttattggtgaagatttcctttagctgttttcataatccatttccattgttatgattattgatgaataaaacattttctttaggtagatacttcttttttccccccaccttgatttaatgtttccactcttattgtcaagtttcttattactccctaataactctcaataaaataatgattcctgggagattattcctgctttcctactatcaccagttgatttgaaaagacagaacaataccgtagaagcttcactaatacattgaaagataaaatgataatactaaatactaaaatatgaaaagtgatactaaaagtggagtcctggcactagtatttttttttttgagtctttaaattttatttatttatttttga

SEQ ID NO: 288061 - DNA, 1805 bp, Homo sapiens
ttaaattaaatgaggtcataagagtggggccctagtctgataggactggtgtccttacaagaagagggagagtcctcagagagtcctctctctcggcatggacacaaaagaaaagccatgtgaggacacagagagaaggtggctgtctacgagctaggaagaaaggcctcaccggaaaccaaccctcacagcagctccatcttggacttccagcctccggaactgtgagaaaataaatgtttgcaattcaggtcggttgtattttgtgaaggccatcctagcaaatgaatactcctaacattgtctctttaagagctcaccagcctgaggtaggaatcattccatctgtgttactaatgagaccgctgaggatcaaaggggttttccaccacatccactcacctctacatggcgaaaaccaagggttcactctctgtcttcagggagctccacccagcagcagcgtttgacagagctgttcacttcctcttcctggagctgtggcttccagagcccatgctcagcagttcccctccttcttcgactgctcctctcttaggctcagagccactcagacattgggaagcaagtttgtcaagatgacagagaaccgaggtaatggattcgagtgatgaaacaggaagttcattcatgagtttttggccacacctccaaagtgacgacttagccagaaatgggataactgggtttccctacttctcttttatcatcctcaatgagagtgaccaaatattagagctagatggaaccttagtgaaaatctggctactcgtcccgtcccaccagcctgccacccatttcaagtttgaagagacaaagacacatggaccttatgtaattactggggattaccccaggagtctgtggcaaaagtcagtttcttccctccctgcttccccgccctgtctctggtactttctaccaacactgggctgtttctgtgatcacacttaagcgtacctaacctgcgaatgctgtatagaaggtgctaatgaacatgatttagctttaacactcagttttctaaagggacacgtgggggcagcaaatgtttaggcaaaaacaattcccagttctagcctctactgtctacatatgtgtatacatttgggaaacgtttgggaaagggatatttgagagcttctttttcttttttgtggtttagttatttgatgatattgagattgtttctgagccatgtgcttcaacatcggattggggatttcagaaaaagttttagtcactgtgattccatttagcttccaaatgtgtctctgctaagagacttaaaagcactcataaatagcacgtgtgtcttctttgcagtgtttgctaattttgagtcacatctttttagaaaatcatgagatttggtgtcacagagactggaataaatatagtcaaacttattggtgaagatttcctttagctgttttcataatccatttccattgttatgattattgatgaataaaacattttctttaggtagatacttcttttttccccccaccttgatttaatgtttccactcttattgtcaagtttcttattactccctaataactctcaataaaataatgattcctgggagattattcctgctttcctactatcaccagttgatttgaaaagacagaacaataccgtagaagcttcactaatacattgaaagataaaatgataatactaaatactaaaatatgaaaagtgatactaaaagtggagtcctggcactagtatttttttttttgagtctttaaattttatttatttatttttga

SEQ ID NO: 288062 - DNA, 2031 bp, Homo sapiens
ttaaattaaatgaggtcataagagtggggccctagtctgataggactggtgtccttacaagaagagggagagtcctcagagagtcctctctctcggcatggacacaaaagaaaagccatgtgaggacacagagagaaggtggctgtctacgagctaggaagaaaggcctcaccggaaaccaaccctcacagcagctccatcttggacttccagcctccggaactgtgagaaaataaatgtttgcaattcaggtcggttgtattttgtgaaggccatcctagcaaatgaatactcctaacattgtctctttaagagctcaccagcctgaggtaggaatcattccatctgtgttactaatgagaccgctgaggatcaaaggggttttccaccacatccactcacctctacatggcgaaaaccaagggttcactctctgtcttcagggagctccacccagcagcagcgtttgacagagctgttcacttcctcttcctggagctgtggcttccagagcccatgctcagcagttcccctccttcttcgactgctcctctcttaggctcaaaacctgtaacaatgcatggcacacggaagatgtgagaatttgctgaataactgaatggcaccatgttgcctcacctaaggataatgactaagaataggaaaaatttactgtgcaaagatcagttcttaatagctgtctacatctcagaacaaaaaaaattagatgtaaaccattgcacaaaggattagatgaaatttttttgaaaaatcagacattggaggctcagagccactcagacattgggaagcaagtttgtcaagatgacagagaaccgaggtaatggattcgagtgatgaaacaggaagttcattcatgagtttttggccacacctccaaagtgacgacttagccagaaatgggataactgggtttccctacttctcttttatcatcctcaatgagagtgaccaaatattagagctagatggaaccttagtgaaaatctggctactcgtcccgtcccaccagcctgccacccatttcaagtttgaagagacaaagacacatggaccttatgtaattactggggattaccccaggagtctgtggcaaaagtcagtttcttccctccctgcttccccgccctgtctctggtactttctaccaacactgggctgtttctgtgatcacacttaagcgtacctaacctgcgaatgctgtatagaaggtgctaatgaacatgatttagctttaacactcagttttctaaagggacacgtgggggcagcaaatgtttaggcaaaaacaattcccagttctagcctctactgtctacatatgtgtatacatttgggaaacgtttgggaaagggatatttgagagcttctttttcttttttgtggtttagttatttgatgatattgagattgtttctgagccatgtgcttcaacatcggattggggatttcagaaaaagttttagtcactgtgattccatttagcttccaaatgtgtctctgctaagagacttaaaagcactcataaatagcacgtgtgtcttctttgcagtgtttgctaattttgagtcacatctttttagaaaatcatgagatttggtgtcacagagactggaataaatatagtcaaacttattggtgaagatttcctttagctgttttcataatccatttccattgttatgattattgatgaataaaacattttctttaggtagatacttcttttttccccccaccttgatttaatgtttccactcttattgtcaagtttcttattactccctaataactctcaataaaataatgattcctgggagattattcctgctttcctactatcaccagttgatttgaaaagacagaacaataccgtagaagcttcactaatacattgaaagataaaatgataatactaaatactaaaatatgaaaagtgatactaaaagtggagtcctggcactagtatttttttttttgagtctttaaattttatttatttatttttga

SEQ ID NO: 288063 - DNA, 1161 bp, Homo sapiens
gtgagaaaatggctcgtcaccttggataccaatgttttacatcagggattggtcactcctgctgctgtcagcactgtaaacactgctggggggagtcagcccaagtccccaccccccagccaggtctcatagagggaattgttcttcaggctcggaggggcctgcctgtcactgcgcccccgaccctagctcagggactgcagaactcaagataccatcccgtttctcctggctgaggaagggaagggaacatccacatcttctgtactcgtccattctgtgtccccggggcctggagtaaagacaccttcaaatgcagagactcttcagattcagctttcctggaaactgatcttcaatgcactaagagaaggagactctcaaaccaaaaatgacctggaggcaccatgtcaggcttctgtttacggtcagtttggcattacagatcatcaatttgggaaacagctatcaaagagagaaacataacggcggtagagaggaagtcaccaaggttgccactcagaagcaccgacagtcaccgctcaactggacctccagtcatttcggagaggtgactgggagcgccgagggctgggggccggaggagccgctcccctactcccgggctttcggagagggtgcgtccgcgcggccgcgctgctgcaggaacggcggtacctgcgtgctgggcagcttctgcgtgtgcccggcccacttcaccggccgctactgcgagcatgaccagaggcgcagtgaatgcggcgccctggagcacggagcctggaccctccgcgcctgccacctctgcaggtgcatcttcggggccctgcactgcctccccctccagacgcctgaccgctgtgacccgaaagacttcctggcctcccacgctcacgggccgagcgccgggggcgcgcccagcctgctactcttgctgccctgcgcactcctgcaccgcctcctgcgcccggatgcgcccgcgcaccctcggtccctggtcccttccgtcctccagcgggagcggcgcccctgcggaaggccgggacttgggcatcgcctttaattttctatgttgtaaataatagatgtgtttagtttaccgtaagctgaagcactgggtgaatatttttattgggtaataaatattttcatgaaagcgcc

SEQ ID NO: 288064 - DNA, 1209 bp, Homo sapiens
gtgagaaaatggctcgtcaccttggataccaatgttttacatcagggattggtcactcctgctgctgtcagcactgtaaacactgctggggggagtcagcccaagtccccaccccccagccaggtctcatagagggaattgttcttcaggctcggaggggcctgcctgtcactgcgcccccgaccctagctcagggactgcagaactcaagataccatcccgtttctcctggctgaggaagggaagggaacatccacatcttctgtactcgtccattctgtgtccccggggcctggagtaaagacaccttcaaatgcagagactcttcagattcagctttcctggaaactgatcttcaatgcactaagagaaggagactctcaaaccaaaaatgacctggaggcaccatgtcaggcttctgtttacggtcagtttggcattacagatcatcaatttgggaaacagctatcaaagagagaaacataacggcggtagagaggaagtcaccaaggttgccactcagaagcaccgacagtcaccgctcaactggacctccagtcatttcggagaggtgactgggagcgccgagggctgggggccggaggagccgctcccctactcccgggctttcggagagggtgcgtccgcgcggccgcgctgctgcaggaacggcggtacctgcgtgctgggcagcttctgcgtgtgcccggcccacttcaccggccgctactgcgagcatgaccagaggcgcagtgaatgcggcgccctggagcacggagcctggaccctccgcgcctgccacctctgcaggtgcatcttcggggccctgcactgcctccccctccagacgcctgaccgctgtgacccgaaagacttcctggcctcccacgctcacgggccgagcgccgggggcgcgcccagcctgctactcttgctgccctgcgcactcctgcaccgcctcctgcgcccggatgcgcccgcgcaccctcggtccctggtcccttccgtcctccagcgggagcggcgcccctgcggaaggccgggacttgggcatcgcctttaattttctatgttgtaaataatagatgtgtttagtttaccgtaagctgaagcactgggtgaatatttttattgggtaataaatattttcatgaaagcgcctttggctccagatccttgggagagggacacgtgtgtccccagcaccac

SEQ ID NO: 288065 - DNA, 1045 bp, Homo sapiens
gtgagaaaatggctcgtcaccttggataccaatgttttacatcagggattggtcactcctgctgctgtcagcactgtaaacactgctggggggagtcagcccaagtccccaccccccagccaggtctcatagagggaattgttcttcaggctcggaggggcctgcctgtcactgcgcccccgaccctagctcagggactgcagaactcaagataccatcccgtttctcctggctgaggaagggaagggaacatccacatcttctgtactcgtccattctgtgtccccggggcctggagtaaagacaccttcaaatgcagagactcttcagattcagctttcctggaaactgatcttcaatgcactaagagaaggagactctcaaaccaaaaatgacctggaggcaccatgtcaggcttctgtttacggtcagtttggcattacagatcatcaatttgggaaacagctatcaaagagagaaacataacggcggtagagaggaagtcaccaaggttgccactcagaagcaccgacagtcaccgctcaactggacctccagtcatttcggagaggtgactgggagcgccgagggctgggggccggaggagccgctcccctactcccgggctttcggagagggtgcgtccgcgcggccgcgctgctgcaggaacggcggtacctgcgtgctgggcagcttctgcgtgtgcccggcccacttcaccggccgctactgcgagcatgaccagaggcgcagtgaatgcggcgccctggagcacggagcctggaccctccgcgcctgccacctctgcaggtgcatcttcggggccctgcactgcctccccctccagacgcctgaccgctgtggtaagaggccctgtgattcggtccccagctcacccccgcacgcggttgcgccttcattgcggctcaccctccataccgatccacagtgcatcttccagtgccaggccacatagcatttagcaaagtagatcgattcatcattgaagaaagtcgcattcattgggaatcatatagtgaattaa

SEQ ID NO: 288066 - DNA, 736 bp, Homo sapiens
acggaagcgagctgatttatatactatagcactgttttaaatcgggtctatgtgccccatcgctcaatgacctggagcgggactccctgaaaggtcacgggccaaatgaaaaagacggaagggctgttcttcgttccccctttaaacacagtactgtaattctccttcagctctccgagttctacaaacatttagaggcttccctctgtgcagccggccgggactggcctccgcacacctcaccctgcagcgcgtcccagggacagagcctagtgagggcgcaggagaaaagggcctgcagaaggcagggagcaggcgtttctattgcactctctcaaaccgagccggaacactttatttcatacatctccggtttctctgtttttccagacccgaaagacttcctggcctcccacgctcacgggccgagcgccgggggcgcgcccagcctgctactcttgctgccctgcgcactcctgcaccgcctcctgcgcccggatgcgcccgcgcaccctcggtccctggtcccttccgtcctccagcgggagcggcgcccctgcggaaggccgggacttgggcatcgcctttaattttctatgttgtaaataatagatgtgtttagtttaccgtaagctgaagcactgggtgaatatttttattgggtaataaatattttcatgaaagcgcctttggctccagatccttgggagagggacacgtgtgtccccagcaccac

SEQ ID NO: 288067 - DNA, 742 bp, Homo sapiens
ctcactctgtcacctaggctggagtgcagtggcgcaatctccactcactgcaagctccgcctcccgagttccagttattctgcatcagcctcccgggtagccaggactacaggcacgtgcaagcacgcccggctaattttgtatttttagtagagacaggtttcaccatgttggtcaggagattgagaccatcctggccaacacggtgcaacaccgtctctactaaaaatacaaaaaaattagctgggcgtggtggtgggcacctgtagtcccagctactcgggagctgggattacaagtgcccgccaccacgcctggtctgccaatactttctatcagtctgtcatgtttactgtcttttcctccatacagaagtttttccttctcagttgggtcaagtccattgacctttctgttacagcttgagttttgtgtcttacgtagaaaaggtgcccctgctctcactttctgcacagctatcaggtccagctcatagcagttcttctatttatccatccactgccccaggagctgcctgggcattcactgccccgcacccctctccagccccaaggtagagctcgggccctgggagtcccaggaccatcccggactggggagctgcttggtgtccagccccgggctcaagctcttctccagctctgcagctacctgaggggtagcagcccggatagcatcctggatgttggttaggtcccactgggtcctcaggagggcactg

SEQ ID NO: 288068 - DNA, 576 bp, Homo sapiens
tgtggtggctcacggctgtaatcccagtactttgggaggccaagccaggcggatcacgaggtcaggagattgagaccatcctggccaacacggtgcaacaccgtctctactaaaaatacaaaaaaattagctgggcgtggtggtgggcacctgtagtcccagctactcgggaggctgaggcaggagaatggcgtgaacctgggaagcggaggttgcagtgagcctagatcgcaccactgcactccagcctgggccacaaagcaagtctcaaaaacaaaaacaaaaacaaaaaaatgattaacatttcaatcagtcaatgggtagactttgagtcacgctgattatccaccacaattgtgggcggagctcattcaataaactgaagacctttaagagaaaagactgaggtcccggccaggtgcggtggctcacgcctgtaatcccagcactttgggaggctgagccaggccaacatggtgaaacctcatctcggatacaaaaaattagccaggtgtggtggcgggcgcctgtgaccccagctacttgggaggctgaggcaggagaatcacttgaacc

SEQ ID NO: 288069 - DNA, 574 bp, Homo sapiens
tgcggccgcggctccagagcccctgggcctcgcgctctgagagcctgagccgcttgaggaggccaagcgcccacgaaccgcattccctgccttgctagttagttctccaacacgcgaaaaaggtagacgaggactggttttctttgcagctaaaatgaatcaagcctctgagattagttgtcactgtgttgcccaggctggtcttaaactcctaggctcgaaggagccttctacctcagcctcccaagtagctgagactataggcgagcacctccacaacatgcactttttatttcctttattttaatttttttttatttttttattatttttagagatggggtcttgctccgtcacccaggctggagttcactgcagcctcaaactcctgggctcactcaaccctcctgcctcagcctcccaaagtattaagatcacaggcataagctaccacgcccagcctgtaccttttatttctttttattgcctaattatagccctatccgttttggtgtcattttaaagtctaaatatatgatgtgtttttttgtcaatatatcacaaattacatatt

SEQ ID NO: 288070 - DNA, 608 bp, Homo sapiens
agtcatgtgtaggtggtcggtcccattgacaacctcaaatgagctgccagccaacaaccagcatcaactgccagtcagcttttgatgccattgtatctgacatcattctaacaggatcaaattgagcaacaacagcaacctaaaaatgagaaagcatggctacttggaacaagatgaagaaataaagcttacggaggttaagtaaatgacctgtttccagtgccggactccaggctctgctggttttacttctaatgcttccatcggaggacaacaatggttacattgacttaagatctgatgcaaatgtttaccttttggggtctgtcataccatgaagcaaacagacagaaaagaaggaaacagatggcacactgaaaattaggataagttaagaagaatgtaataagcggacaaccgacaaaggagggtgggaatgcagggcaaccgcaagggctcatacagtgctgggtgaggaggacccctgacgggagctgagatctttggtgaaggacacaactggtcagtacaaccctgcagggcaaggagctgcagaaacaactatccaaaccccacacctctccctcaccttgatctcccatgttcca

SEQ ID NO: 288071 - DNA, 2497 bp, Homo sapiens
acaggaagcgggcgcgcgacggctcctccgggcagcgcagcgcgggcgcctcttccactgtgaccacgggcgcgcgggccaagggggcgcggcggggcctcccgggctgatcggccgaagcccgggccccgcgcggcctctggcgggctgacgccgggaggaggggcgggggctggccagatgactgtatctatgcaaaggcggaggcggtgggcggggagggggctggattcagtagagggcaaggggcactcacatccccggcgcgccactcgcggggctcctttctgcacgtgccccgggcctctcccgctcgctcaacctgtctgcggagggcgcgctctcgcgcaccctgctcccgcgttcgcttctttgttcccgcccacgcgaggcccattttgacggatccagttcgaggcctgacggcggccaatcggcgctggcgccttcaccctccccgccccgccgaacccgtcaagggccgccccttttcctgcccacgtggtctcgggctcctgccccgtcctgctcacgagttcagggctcctgggcggccgccttttccagttccaggtgtgcagaagtgtcctctccccacgcgcggcgggctgcacttggtcgctggctccgagatcgcgcggggccgccggaagcccaagacggtaccgggggccgcagccgcagccggcgccgccctccgccctccccaacagcaggccgagtcccgtagcatccggtagggaaatggtcgtgctttcggtccccgccgaagtcaccgtgatcctgttagatatcgaaggtaccacaaccccgattgctttcgtgaaggacattttatttccttacatcgaagaaaatgttaaagagtatctgcagacacattgggaagaagaggagtgccagcaggatgtcagtcttttgaggaaacaggctgaagaggacgcccacctggatggggctgttcctatccctgcagcatctgggaatggagtggatgatctgcaacagatgatccaggccgtggtagataatgtgtgctggcagatgtccctggatcgaaagaccactgcactcaaacagctgcagggccacatgtggagggcggcattcacagctgggcgcatgaaagcagagttctttgcagatgtagttccagcagtcaggaagtggagagaggccggaatgaaggtgtacatctattcctcagggagtgtggaggcacagaaactgttattcgggcattctacggagggagatattcttgagcttgttgatggtcactttgataccaagattggacacaaagtagagagtgaaagttaccgaaagattgcagacagcattgggtgctcaaccaacaacattttgtttctgacagatgttactcgagaggccagtgctgctgaggaagcagatgtgcacgtagctgtggtggtgagaccaggcaacgcaggattaacagatgatgagaagacttactacagcctcatcacatccttcagtgaactatacctgccttcctcaacctagagaagggttgttaaggcagaccgccctgttccccagagttgtccctgtagtgtctaggtttattctaatggtaaaagtaacttacttaaaaaacatatgtacacatatgtatgcaagtatgtatatatgtgtatgctcagattaacttccataggtacataagtgaaagaagtctcagttcagtgaacacaaaacttatttaaagatgctttatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgttattttaaaaatgaaatatttcaaagactgaatattttcaaagaaaatgaataattcattgcccttgtgatttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttgccttaccagtgaaaaaggtgcactgaggtaacatctaaaacagagatgtggttcttaatgtttaacagaacagttctaatcctgccacgtgttatcattatagattttatagttgcctttctaactacttagcacagtttgagaatacgttaattgctatttactatttaaaaagttttactgaaatcagtccataacattaagatgagccctaatatgtaagattttcctctggaatggatgtgagaaatgtaaattttataacagcagtatttatcctggtttaattctaatacgatgtcatgttaatttcatgttgtgattaataaaagcattttttcttca

SEQ ID NO: 288072 - DNA, 2018 bp, Homo sapiens
ggaaattaaggctaggtacgaggcctggtggtgctcctgccccgtcctgctcacgagttcagggctcctgggcggccgccttttccagttccaggtgtgcagaagtgtcctctccccacgcgcggcgggctgcacttggtcgctggctccgagatcgcgcggggccgccggaagcccaagacggtaccgggggccgcagccgcagccggcgccgccctccgccctccccaacagcaggccgagtcccgtagcatccggtagggaaatggtcgtgctttcggtccccgccgaagtcaccgtgatcctgttagatatcgaaggtaccacaaccccgattgctttcgtgaaggacattttatttccttacatcgaagaaaatgttaaagagtatctgcagacacattgggaagaagaggagtgccagcaggatgtcagtcttttgaggaaacaggctgaagaggacgcccacctggatggggctgttcctatccctgcagcatctgggaatggagtggatgatctgcaacagatgatccaggccgtggtagataatgtgtgctggcagatgtccctggatcgaaagaccactgcactcaaacagctgcagggccacatgtggagggcggcattcacagctgggcgcatgaaagcagagttctttgcagatgtagttccagcagtcaggaagtggagagaggccggaatgaaggtgtacatctattcctcagggagtgtggaggcacagaaactgttattcgggcattctacggagggagatattcttgagcttgttgatggtcactttgataccaagattggacacaaagtagagagtgaaagttaccgaaagattgcagacagcattgggtgctcaaccaacaacattttgtttctgacagatgttactcgagaggccagtgctgctgaggaagcagatgtgcacgtagctgtggtggtgagaccaggcaacgcaggattaacagatgatgagaagacttactacagcctcatcacatccttcagtgaactatacctgccttcctcaacctagagaagggttgttaaggcagaccgccctgttccccagagttgtccctgtagtgtctaggtttattctaatggtaaaagtaacttacttaaaaaacatatgtacacatatgtatgcaagtatgtatatatgtgtatgctcagattaacttccataggtacataagtgaaagaagtctcagttcagtgaacacaaaacttatttaaagatgctttatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgttattttaaaaatgaaatatttcaaagactgaatattttcaaagaaaatgaataattcattgcccttgtgatttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttgccttaccagtgaaaaaggtgcactgaggtaacatctaaaacagagatgtggttcttaatgtttaacagaacagttctaatcctgccacgtgttatcattatagattttatagttgcctttctaactacttagcacagtttgagaatacgttaattgctatttactatttaaaaagttttactgaaatcagtccataacattaagatgagccctaatatgtaagattttcctctggaatggatgtgagaaatgtaaattttataacagcagtatttatcctggtttaattctaatacgatgtcatgttaatttcatgttgtgattaataaaagcattttttcttca

SEQ ID NO: 288073 - DNA, 3139 bp, Homo sapiens
acaggaagcgggcgcgcgacggctcctccgggcagcgcagcgcgggcgcctcttccactgtgaccacgggcgcgcgggccaagggggcgcggcggggcctcccgggctgatcggccgaagcccgggccccgcgcggcctctggcgggctgacgccgggaggaggggcgggggctggccagatgactgtatctatgcaaaggcggaggcggtgggcggggagggggctggattcagtagagggcaaggggcactcacatccccggcgcgccactcgcggggctcctttctgcacgtgccccgggcctctcccgctcgctcaacctgtctgcggagggcgcgctctcgcgcaccctgctcccgcgttcgcttctttgttcccgcccacgcgaggcccattttgacggatccagttcgaggcctgacggcggccaatcggcgctggcgccttcaccctccccgccccgccgaacccgtcaagggccgccccttttcctgcccacgtggtctcgggctcctgccccgtcctgctcacgagttcagggctcctgggcggccgccttttccagttccaggtgtgcagaagtgtcctctccccacgcgcggcgggctgcacttggtcgctggctccgagatcgcgcggggccgccggaagcccaagacggtaccgggggccgcagccgcagccggcgccgccctccgccctccccaacagcaggccgagtcccgtagcatccggtagggaaatggtcgtgctttcggtccccgccgaagtcaccgtgatcctgttagatatcgaaggtaccacaaccccgattgctttcgtgaaggacattttatttccttacatcgaagaaaatgttaaagagtatctgcagacacattgggaagaagaggagtgccagcaggatgtcagtcttttgaggaaacaggctgaagaggacgcccacctggatggggctgttcctatccctgcagcatctgggaatggagtggatgatctgcaacagatgatccaggccgtggtagataatgtgtgctggcagatgtccctggatcgaaagaccactgcactcaaacagctgcagggccacatgtggagggcggcattcacagctgggcgcatgaaagcagagttctttgcagatgtagttccagcagtcaggaagtggagagaggccggaatgaaggtgtacatctattcctcagggagtgtggaggcacagaaactgttattcgggcattctacggagggagatattcttgagcttgttgatggtcactttgataccaagattggacacaaagtagagagtgaaagttaccgaaagattgcagacagcattgggtgctcaaccaacaacattttgtttctgacagatgttactcgagaggccagtgctgctgaggaagcagatgtgcacgtagctgtggtggtgagaccaggcaacgcaggattaacagatgatgagaagacttactacagcctcatcacatccttcagtgaactatacctgccttcctcaacctagagaagggttgttaaggcagaccgccctgttccccagagttgtccctgtagtgtctaggtttattctaatggtaaaagtaacttacttaaaaaacatatgtacacatatgtatgcaagtatgtatatatgtgtatgctcagattaacttccataggtacataagtgaaagaagtctcagttcagtgaacacaaaacttatttaaagatgctttatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgttattttaaaaatgaaatatttcaaagactgaatattttcaaagaaaatgaataattcattgcccttgtgatttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttgccttaccagtgaaaaaggtgcactgaggtaacatctaaaacagagatgtggttcttaatgtttaacagaacagttctaatcctgccacgtgttatcattatagattttatagttgcctttctaactacttagcacagtttgagaatacgttaattgctatttactatttaaaaagttttactgaaatcagtccataacattaagatgagccctaatatgtaagattttcctctggaatggatgtgagaaatgtaaattttataacagcagtatttatcctggtttaattctaatacgatgtcatgttaatttcatgttgtgattaataaaagcattttttcttcaaaaaaaaaaaaaaaaaaaaaaaaaaaaaaaaaaaaaaaaaaaaaaaaaaaaaaaaaaaaaaaaaaaaaaaaaaaaaaaaagagagggcgggcgcgcgcgccgcgacaaaatactatcccccgagggcgcgccgcacaatagccgccggcacgccgacgttttttgaaagcagagggcggcgctctccacaatatagggagcggatgatattataatataagaccgagagagcggcgcggcgcagcgcagtataatcagaacacgagcggcgggagcaaggggaggaaaatagcgagcgagcacgagcgagggacactagtggggaagaaagagcaccccaacaaatacgggggggggggagcaaaacaagttatggagacaacaaacatcaccaaccgaagaaagtaatctacacaacagccgcacgggagggggacaaataaaataaagaaaatgaggcgagcagagacagtacaagggggaggtgaaacaacacaaacgaacgagaggaaaaatacgtaacgctcgggagcgaaggcaagatacatcatggggagacaaaacgaagtaataaaacgagtcgaagaggcaaaaaactttatcaaagcgggggaaggagacgacataaacacacacagagga

SEQ ID NO: 288074 - DNA, 2265 bp, Homo sapiens
acaggaagcgggcgcgcgacggctcctccgggcagcgcagcgcgggcgcctcttccactgtgaccacgggcgcgcgggccaagggggcgcggcggggcctcccgggctgatcggccgaagcccgggccccgcgcggcctctggcgggctgacgccgggaggaggggcgggggctggccagatgactgtatctatgcaaaggcggaggcggtgggcggggagggggctggattcagtagagggcaaggggcactcacatccccggcgcgccactcgcggggctcctttctgcacgtgccccgggcctctcccgctcgctcaacctgtctgcggagggcgcgctctcgcgcaccctgctcccgcgttcgcttctttgttcccgcccacgcgaggcccattttgacggatccagttcgaggcctgacggcggccaatcggcgctggcgccttcaccctccccgccccgccgaacccgtcaagggccgccccttttcctgcccacgtggtctcgggctcctgccccgtcctgctcacgagttcagggctcctgggcggccgccttttccagttccaggtgtgcagaagtgtcctctccccacgcgcggcgggctgcacttggtcgctggctccgagatcgcgcggggccgccggaagcccaagacggtaccgggggccgcagccgcagccggcgccgccctccgccctccccaacagcaggccgagtcccgtagcatccggtagggaaatggtcgtgctttcggtccccgccgaagtcaccgtgatcctgttagatatcgaaggacattttatttccttacatcgaagaaaatgttaaagagtatctgcagacacattgggaagaagaggagtgccagcaggatgtcagtcttttgaggaaacaggttctttgcagatgtagttccagcagtcaggaagtggagagaggccggaatgaaggtgtacatctattcctcagggagtgtggaggcacagaaactgttattcgggcattctacggagggagatattcttgagcttgttgatggtcactttgataccaagattggacacaaagtagagagtgaaagttaccgaaagattgcagacagcattgggtgctcaaccaacaacattttgtttctgacagatgttactcgagaggccagtgctgctgaggaagcagatgtgcacgtagctgtggtggtgagaccaggcaacgcaggattaacagatgatgagaagacttactacagcctcatcacatccttcagtgaactatacctgccttcctcaacctagagaagggttgttaaggcagaccgccctgttccccagagttgtccctgtagtgtctaggtttattctaatggtaaaagtaacttacttaaaaaacatatgtacacatatgtatgcaagtatgtatatatgtgtatgctcagattaacttccataggtacataagtgaaagaagtctcagttcagtgaacacaaaacttatttaaagatgctttatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgttattttaaaaatgaaatatttcaaagactgaatattttcaaagaaaatgaataattcattgcccttgtgatttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttgccttaccagtgaaaaaggtgcactgaggtaacatctaaaacagagatgtggttcttaatgtttaacagaacagttctaatcctgccacgtgttatcattatagattttatagttgcctttctaactacttagcacagtttgagaatacgttaattgctatttactatttaaaaagttttactgaaatcagtccataacattaagatgagccctaatatgtaagattttcctctggaatggatgtgagaaatgtaaattttataacagcagtatttatcctggtttaattctaatacgatgtcatgttaatttcatgttgtgattaataaaagcattttttcttca

SEQ ID NO: 288075 - DNA, 2294 bp, Homo sapiens
acaggaagcgggcgcgcgacggctcctccgggcagcgcagcgcgggcgcctcttccactgtgaccacgggcgcgcgggccaagggggcgcggcggggcctcccgggctgatcggccgaagcccgggccccgcgcggcctctggcgggctgacgccgggaggaggggcgggggctggccagatgactgtatctatgcaaaggcggaggcggtgggcggggagggggctggattcagtagagggcaaggggcactcacatccccggcgcgccactcgcggggctcctttctgcacgtgccccgggcctctcccgctcgctcaacctgtctgcggagggcgcgctctcgcgcaccctgctcccgcgttcgcttctttgttcccgcccacgcgaggcccattttgacggatccagttcgaggcctgacggcggccaatcggcgctggcgccttcaccctccccgccccgccgaacccgtcaagggccgccccttttcctgcccacgtggtctcgggctcctgccccgtcctgctcacgagttcagggctcctgggcggccgccttttccagttccaggtgtgcagaagtgtcctctccccacgcgcggcgggctgcacttggtcgctggctccgagatcgcgcggggccgccggaagcccaagacggtaccgggggccgcagccgcagccggcgccgccctccgccctccccaacagcaggccgagtcccgtagcatccggtagggaaatggtcgtgctttcggtccccgccgaagtcaccgtgatcctgttagatatcgaaggtaccacaaccccgattgctttcgtgaaggacattttatttccttacatcgaagaaaatgttaaagagtatctgcagacacattgggaagaagaggagtgccagcaggatgtcagtcttttgaggaaacaggttctttgcagatgtagttccagcagtcaggaagtggagagaggccggaatgaaggtgtacatctattcctcagggagtgtggaggcacagaaactgttattcgggcattctacggagggagatattcttgagcttgttgatggtcactttgataccaagattggacacaaagtagagagtgaaagttaccgaaagattgcagacagcattgggtgctcaaccaacaacattttgtttctgacagatgttactcgagaggccagtgctgctgaggaagcagatgtgcacgtagctgtggtggtgagaccaggcaacgcaggattaacagatgatgagaagacttactacagcctcatcacatccttcagtgaactatacctgccttcctcaacctagagaagggttgttaaggcagaccgccctgttccccagagttgtccctgtagtgtctaggtttattctaatggtaaaagtaacttacttaaaaaacatatgtacacatatgtatgcaagtatgtatatatgtgtatgctcagattaacttccataggtacataagtgaaagaagtctcagttcagtgaacacaaaacttatttaaagatgctttatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgttattttaaaaatgaaatatttcaaagactgaatattttcaaagaaaatgaataattcattgcccttgtgatttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttgccttaccagtgaaaaaggtgcactgaggtaacatctaaaacagagatgtggttcttaatgtttaacagaacagttctaatcctgccacgtgttatcattatagattttatagttgcctttctaactacttagcacagtttgagaatacgttaattgctatttactatttaaaaagttttactgaaatcagtccataacattaagatgagccctaatatgtaagattttcctctggaatggatgtgagaaatgtaaattttataacagcagtatttatcctggtttaattctaatacgatgtcatgttaatttcatgttgtgattaataaaagcattttttcttca

SEQ ID NO: 288076 - DNA, 1856 bp, Homo sapiens
atgaacgaggctgaatcgtgagtttatagcttgagccttcaaacttggtttgattattttgggtgcagatctttctaaaagcatttccatgctttcttaaagcacagtggacataatttaaccttttcttgtcatgaagaacatcaaagattatattatatcattgctgttgtttgcttttttgagttcttcgggaatttaaaaaacactttcccatttcatccttttatctgtagtccctttttactgtcactagtggctgtctgttcaaaactatcctcctttccacatagattgttgcttctaatctgctgtgagcctggaacttgggcagtacgtttattagaactgcaggagtttgtaatctcagggagctgcttctcaggttaccatgtgggcacaaagagagaaacatatggcatctgttttgacaggtttttatctggctagatgaggtgttcctgtattttaacttagtggtcttccctctaggttctttgcagatgtagttccagcagtcaggaagtggagagaggccggaatgaaggtgtacatctattcctcagggagtgtggaggcacagaaactgttattcgggcattctacggagggagatattcttgagcttgttgatggtcactttgataccaagattggacacaaagtagagagtgaaagttaccgaaagattgcagacagcattgggtgctcaaccaacaacattttgtttctgacagatgttactcgagaggccagtgctgctgaggaagcagatgtgcacgtagctgtggtggtgagaccaggcaacgcaggattaacagatgatgagaagacttactacagcctcatcacatccttcagtgaactatacctgccttcctcaacctagagaagggttgttaaggcagaccgccctgttccccagagttgtccctgtagtgtctaggtttattctaatggtaaaagtaacttacttaaaaaacatatgtacacatatgtatgcaagtatgtatatatgtgtatgctcagattaacttccataggtacataagtgaaagaagtctcagttcagtgaacacaaaacttatttaaagatgctttatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgttattttaaaaatgaaatatttcaaagactgaatattttcaaagaaaatgaataattcattgcccttgtgatttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttgccttaccagtgaaaaaggtgcactgaggtaacatctaaaacagagatgtggttcttaatgtttaacagaacagttctaatcctgccacgtgttatcattatagattttatagttgcctttctaactacttagcacagtttgagaatacgttaattgctatttactatttaaaaagttttactgaaatcagtccataacattaagatgagccctaatatgtaagattttcctctggaatggatgtgagaaatgtaaattttataacagcagtatttatcctggtttaattctaatacgatgtcatgttaatttcatgttgtgattaataaaagcattttttcttca

SEQ ID NO: 288077 - DNA, 2585 bp, Homo sapiens
acaggaagcgggcgcgcgacggctcctccgggcagcgcagcgcgggcgcctcttccactgtgaccacgggcgcgcgggccaagggggcgcggcggggcctcccgggctgatcggccgaagcccgggccccgcgcggcctctggcgggctgacgccgggaggaggggcgggggctggccagatgactgtatctatgcaaaggcggaggcggtgggcggggagggggctggattcagtagagggcaaggggcactcacatccccggcgcgccactcgcggggctcctttctgcacgtgccccgggcctctcccgctcgctcaacctgtctgcggagggcgcgctctcgcgcaccctgctcccgcgttcgcttctttgttcccgcccacgcgaggcccattttgacggatccagttcgaggcctgacggcggccaatcggcgctggcgccttcaccctccccgccccgccgaacccgtcaagggccgccccttttcctgcccacgtggtctcgggctcctgccccgtcctgctcacgagttcagggctcctgggcggccgccttttccagttccaggtgtgcagaagtgtcctctccccacgcgcggcgggctgcacttggtcgctggctccgagatcgcgcggggccgccggaagcccaagacggtaccgggggccgcagccgcagccggcgccgccctccgccctccccaacagcaggccgagtcccgtagcatccggtagggaaatggtcgtgctttcggtccccgccgaagtcaccgtgatcctgttagatatcgaaggtaccacaaccccgattgctttcgtgaaggacattttatttccttacatcgaagaaaatgttaaagagtatctgcagacacattgggaagaagaggagtgccagcaggatgtcagtcttttgaggaaacaggctgaagaggacgcccacctggatggggctgttcctatccctgcagcatctgggaatggagtggatgatctgcaacagatgatccaggccgtggtagataatgtgtgctggcagatgtccctggatcgaaagaccactgcactcaaacagctgcagggccacatgtggagggcggcattcacagctgggcgcatgaaagcagagttctttgcagatgtagttccagcagtcaggaagtggagagaggccggaatgaaggtgtacatctattcctcagggagtgtggaggcacagaaactgttattcgggcattctacggagggagatattcttgagcttgttgatggtcactttgataccaagattggacacaaagtagagagtgaaagttaccgaaagattgcagacagcattgggtgctcaaccaacaacattttgtttctgacagatgttactcgagaggccagtgctgctgaggaagcagatgtgcacgtagctgtggtggtgagaccaggcaacgcaggattaacagatgatgagaagacttactacagcctcatcacatccttcagtgaactatacctgccttcctcaacctagagaagggttgttaaggcagaccgccctgttccccagagttgtccctgtagtgtctaggtttattctaatggtaaaagtaacttacttaaaaaacatatgtacacatatgtatgcaagtatgtatatatgtgtatgctcagattaacttccataggtacataagtgaaagaagtctcagttcagtgaacacaaaacttatttaaagatgctttatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgttattttaaaaatgaaatatttcaaagactgaatattttcaaagaaaatgaataattcattgcccttgtgatttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttgccttaccagtgaaaaaggtgcactgaggtaacatctaaaacagagatgtggttcttaatgtttaacagaacagttctaatcctgccacgtgttatcattatagattttatagttgcctttctaactacttagcacagtttgagaatacgttaattgctatttactatttaaaaagttttactgaaatcagtccataacattaagatgagccctaatatgtaagattttcctctggaatggatgtgagaaatgtaaattttataacagcagtatttatcctggtttaattctaatacgatgtcatgttaatttcatgttgtgattaataaaagcattttttcttcactcagttttatataggttcctgaactctatccacatgccgccatagcaaaagagaaactgaaaaacaagaatatttagctcttatctt

SEQ ID NO: 288078 - DNA, 1006 bp, Homo sapiens
ctagaggatccccgttcacttgctacaccctcaacctagagaagggttgttaaggcagaccgccctgttccccagagttgtccctgtagtgtctaggtttattctaatggtaaaagtaacttacttaaaaaacatatgtacacatatgtatgcaagtatgtatatatgtgtatgctcagattaacttccataggtacataagtgaaagaagtctcagttcagtgaacacaaaacttatttaaagatgctttatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgttattttaaaaatgaaatatttcaaagactgaatattttcaaagaaaatgaataattcattgcccttgtgatttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttgccttaccagtgaaaaaggtgcactgaggtaacatctaaaacagagatgtggttcttaatgtttaacagaacagttctaatcctgccacgtgttatcattatagattttatagttgcctttctaactacttagcacagtttgagaatacgttaattgctatttactatttaaaaagttttactgaaatcagtccataacattaagatgagccctaatatgtaagattttcctctggaatggatgtgagaaatgtaaattttataacagcagtatttatcctggtttaattctaatacgatgtcatgttaatttcatgttgtgattaataaaagcattttttcttca

SEQ ID NO: 288079 - DNA, 1162 bp, Homo sapiens
  misc_feature (218)..(218): n is a, c, g, or t
aatctagatagaacagttgttggggacgcggatgtgctcgttacttgagtgtggacatcggtgtaccctaggtagatccggtgcttgaataatgcattgagattctcatcaatatacctaaagtcgcaaggctgataactgcattgcttctagacctaagaatcacaggagtgtgtgtaacgtgcaggatcgtctcactggtgactcttatgaaatcnggtccgtgcaaggcgtacgtatgcgtataatcacatatataggtcaccacggttactgttacttaaaaaacatatgtacacatatgtatgcaagtatgtatatatgtgtatgctcagattaacttccataggtacataagtgaaagaagtctcagttcagtgaacacaaaacttatttaaagatgctttatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgttattttaaaaatgaaatatttcaaagactgaatattttcaaagaaaatgaataattcattgcccttgtgatttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttgccttaccagtgaaaaaggtgcactgaggtaacatctaaaacagagatgtggttcttaatgtttaacagaacagttctaatcctgccacgtgttatcattatagattttatagttgcctttctaactacttagcacagtttgagaatacgttaattgctatttactatttaaaaagttttactgaaatcagtccataacattaagatgagccctaatatgtaagattttcctctggaatggatgtgagaaatgtaaattttataacagcagtatttatcctggtttaattctaatacgatgtcatgttaatttcatgttgtgattaataaaagcattttttcttca

SEQ ID NO: 288080 - DNA, 1480 bp, Homo sapiens
acaggaagcgggcgcgcgacggctcctccgggcagcgcagcgcgggcgcctcttccactgtgaccacgggcgcgcgggccaagggggcgcggcggggcctcccgggctgatcggccgaagcccgggccccgcgcggcctctggcgggctgacgccgggaggaggggcgggggctggccagatgactgtatctatgcaaaggcggaggcggtgggcggggagggggctggattcagtagagggcaaggggcactcacatccccggcgcgccactcgcggggctcctttctgcacgtgccccgggcctctcccgctcgctcaacctgtctgcggagggcgcgctctcgcgcaccctgctcccgcgttcgcttctttgttcccgcccacgcgaggcccattttgacggatccagttcgaggcctgacggcggccaatcggcgctggcgccttcaccctccccgccccgccgaacccgtcaagggccgccccttttcctgcccacgtggtctcgggctcctgccccgtcctgctcacgagttcagggctcctgggcggccgccttttccagttccaggtgtgcagaagtgtcctctccccacgcgcggcgggctgcacttggtcgctggctccgagatcgcgcggggccgccggaagcccaagacggtaccgggggccgcagccgcagccggcgccgccctccgccctccccaacagcaggccgagtcccgtagcatccggtagggaaatggtcgtgctttcggtccccgccgaagtcaccgtgatcctgttagatatcgaaggtaccacaaccccgattgctttcgtgaaggacattttatttccttacatcgaagaaaatgttaaagagtatctgcagacacattgggaagaagaggagtgccagcaggatgtcagtcttttgaggaaacaggctgaagaggacgcccacctggatggggctgttcctatccctgcagcatctgggaatggagtggatgatctgcaacagatgatccaggccgtggtagataatgtgtgctggcagatgtccctggatcgaaagaccactgcactcaaacagctgcagggccacatgtggagggcggcattcacagctgggcgcatgaaagcagagttctttgcagatgtagttccagcagtcaggaagtggagagaggccggaatgaaggtgtacatctattcctcagggagtgtggaggcacagaaactgttattcgggcattctacggagggagatattcttgaggtaggttacctagtttactttgttgttttgacgctatcaaagcataaaataatgaatcttaatggaaaactaattggaactaatagaatgcttttttttttttggttgtttaaaattaggtaagaagaaaataatcacttttaattatattgtatttacagtttcttctatataaggttgttatataaagtttattctgtgtcttgaaaaataa

SEQ ID NO: 288081 - DNA, 2468 bp, Homo sapiens
acaggaagcgggcgcgcgacggctcctccgggcagcgcagcgcgggcgcctcttccactgtgaccacgggcgcgcgggccaagggggcgcggcggggcctcccgggctgatcggccgaagcccgggccccgcgcggcctctggcgggctgacgccgggaggaggggcgggggctggccagatgactgtatctatgcaaaggcggaggcggtgggcggggagggggctggattcagtagagggcaaggggcactcacatccccggcgcgccactcgcggggctcctttctgcacgtgccccgggcctctcccgctcgctcaacctgtctgcggagggcgcgctctcgcgcaccctgctcccgcgttcgcttctttgttcccgcccacgcgaggcccattttgacggatccagttcgaggcctgacggcggccaatcggcgctggcgccttcaccctccccgccccgccgaacccgtcaagggccgccccttttcctgcccacgtggtctcgggctcctgccccgtcctgctcacgagttcagggctcctgggcggccgccttttccagttccaggtgtgcagaagtgtcctctccccacgcgcggcgggctgcacttggtcgctggctccgagatcgcgcggggccgccggaagcccaagacggtaccgggggccgcagccgcagccggcgccgccctccgccctccccaacagcaggccgagtcccgtagcatccggtagggaaatggtcgtgctttcggtccccgccgaagtcaccgtgatcctgttagatatcgaaggacattttatttccttacatcgaagaaaatgttaaagagtatctgcagacacattgggaagaagaggagtgccagcaggatgtcagtcttttgaggaaacaggctgaagaggacgcccacctggatggggctgttcctatccctgcagcatctgggaatggagtggatgatctgcaacagatgatccaggccgtggtagataatgtgtgctggcagatgtccctggatcgaaagaccactgcactcaaacagctgcagggccacatgtggagggcggcattcacagctgggcgcatgaaagcagagttctttgcagatgtagttccagcagtcaggaagtggagagaggccggaatgaaggtgtacatctattcctcagggagtgtggaggcacagaaactgttattcgggcattctacggagggagatattcttgagcttgttgatggtcactttgataccaagattggacacaaagtagagagtgaaagttaccgaaagattgcagacagcattgggtgctcaaccaacaacattttgtttctgacagatgttactcgagaggccagtgctgctgaggaagcagatgtgcacgtagctgtggtggtgagaccaggcaacgcaggattaacagatgatgagaagacttactacagcctcatcacatccttcagtgaactatacctgccttcctcaacctagagaagggttgttaaggcagaccgccctgttccccagagttgtccctgtagtgtctaggtttattctaatggtaaaagtaacttacttaaaaaacatatgtacacatatgtatgcaagtatgtatatatgtgtatgctcagattaacttccataggtacataagtgaaagaagtctcagttcagtgaacacaaaacttatttaaagatgctttatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgttattttaaaaatgaaatatttcaaagactgaatattttcaaagaaaatgaataattcattgcccttgtgatttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttgccttaccagtgaaaaaggtgcactgaggtaacatctaaaacagagatgtggttcttaatgtttaacagaacagttctaatcctgccacgtgttatcattatagattttatagttgcctttctaactacttagcacagtttgagaatacgttaattgctatttactatttaaaaagttttactgaaatcagtccataacattaagatgagccctaatatgtaagattttcctctggaatggatgtgagaaatgtaaattttataacagcagtatttatcctggtttaattctaatacgatgtcatgttaatttcatgttgtgattaataaaagcattttttcttca

SEQ ID NO: 288082 - DNA, 2413 bp, Homo sapiens
acaggaagcgggcgcgcgacggctcctccgggcagcgcagcgcgggcgcctcttccactgtgaccacgggcgcgcgggccaagggggcgcggcggggcctcccgggctgatcggccgaagcccgggccccgcgcggcctctggcgggctgacgccgggaggaggggcgggggctggccagatgactgtatctatgcaaaggcggaggcggtgggcggggagggggctggattcagtagagggcaaggggcactcacatccccggcgcgccactcgcggggctcctttctgcacgtgccccgggcctctcccgctcgctcaacctgtctgcggagggcgcgctctcgcgcaccctgctcccgcgttcgcttctttgttcccgcccacgcgaggcccattttgacggatccagttcgaggcctgacggcggccaatcggcgctggcgccttcaccctccccgccccgccgaacccgtcaagggccgccccttttcctgcccacgtggtctcgggctcctgccccgtcctgctcacgagttcagggctcctgggcggccgccttttccagttccaggtgtgcagaagtgtcctctccccacgcgcggcgggctgcacttggtcgctggctccgagatcgcgcggggccgccggaagcccaagacggtaccgggggccgcagccgcagccggcgccgccctccgccctccccaacagcaggccgagtcccgtagcatccggtagggaaatggtcgtgctttcggtccccgccgaagtcaccgtgatcctgttagatatcgaagacattttatttccttacatcgaagatgtcagtcttttgaggaaacaggctgaagaggacgcccacctggatggggctgttcctatccctgcagcatctgggaatggagtggatgatctgcaacagatgatccaggccgtggtagataatgtgtgctggcagatgtccctggatcgaaagaccactgcactcaaacagctgcagggccacatgtggagggcggcattcacagctgggcgcatgaaagcagagttctttgcagatgtagttccagcagtcaggaagtggagagaggccggaatgaaggtgtacatctattcctcagggagtgtggaggcacagaaactgttattcgggcattctacggagggagatattcttgagcttgttgatggtcactttgataccaagattggacacaaagtagagagtgaaagttaccgaaagattgcagacagcattgggtgctcaaccaacaacattttgtttctgacagatgttactcgagaggccagtgctgctgaggaagcagatgtgcacgtagctgtggtggtgagaccaggcaacgcaggattaacagatgatgagaagacttactacagcctcatcacatccttcagtgaactatacctgccttcctcaacctagagaagggttgttaaggcagaccgccctgttccccagagttgtccctgtagtgtctaggtttattctaatggtaaaagtaacttacttaaaaaacatatgtacacatatgtatgcaagtatgtatatatgtgtatgctcagattaacttccataggtacataagtgaaagaagtctcagttcagtgaacacaaaacttatttaaagatgctttatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgttattttaaaaatgaaatatttcaaagactgaatattttcaaagaaaatgaataattcattgcccttgtgatttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttgccttaccagtgaaaaaggtgcactgaggtaacatctaaaacagagatgtggttcttaatgtttaacagaacagttctaatcctgccacgtgttatcattatagattttatagttgcctttctaactacttagcacagtttgagaatacgttaattgctatttactatttaaaaagttttactgaaatcagtccataacattaagatgagccctaatatgtaagattttcctctggaatggatgtgagaaatgtaaattttataacagcagtatttatcctggtttaattctaatacgatgtcatgttaatttcatgttgtgattaataaaagcattttttcttca

SEQ ID NO: 288083 - DNA, 2153 bp, Homo sapiens
acaggaagcgggcgcgcgacggctcctccgggcagcgcagcgcgggcgcctcttccactgtgaccacgggcgcgcgggccaagggggcgcggcggggcctcccgggctgatcggccgaagcccgggccccgcgcggcctctggcgggctgacgccgggaggaggggcgggggctggccagatgactgtatctatgcaaaggcggaggcggtgggcggggagggggctggattcagtagagggcaaggggcactcacatccccggcgcgccactcgcggggctcctttctgcacgtgccccgggcctctcccgctcgctcaacctgtctgcggagggcgcgctctcgcgcaccctgctcccgcgttcgcttctttgttcccgcccacgcgaggcccattttgacggatccagttcgaggcctgacggcggccaatcggcgctggcgccttcaccctccccgccccgccgaacccgtcaagggccgccccttttcctgcccacgtggtctcgggctcctgccccgtcctgctcacgagttcagggctcctgggcggccgccttttccagttccaggtgtgcagaagtgtcctctccccaacagcaggccgagtcccgtagcatccggtagggaaatggtcgtgctttcggtccccgccgaagtcaccgtgatcctgttagatatcgaaggacattttatttccttacatcgaagaaaatgttaaagagtatctgcagacacattgggaagaagaggagtgccagcaggatgtcagtcttttgaggaaacaggttctttgcagatgtagttccagcagtcaggaagtggagagaggccggaatgaaggtgtacatctattcctcagggagtgtggaggcacagaaactgttattcgggcattctacggagggagatattcttgagcttgttgatggtcactttgataccaagattggacacaaagtagagagtgaaagttaccgaaagattgcagacagcattgggtgctcaaccaacaacattttgtttctgacagatgttactcgagaggccagtgctgctgaggaagcagatgtgcacgtagctgtggtggtgagaccaggcaacgcaggattaacagatgatgagaagacttactacagcctcatcacatccttcagtgaactatacctgccttcctcaacctagagaagggttgttaaggcagaccgccctgttccccagagttgtccctgtagtgtctaggtttattctaatggtaaaagtaacttacttaaaaaacatatgtacacatatgtatgcaagtatgtatatatgtgtatgctcagattaacttccataggtacataagtgaaagaagtctcagttcagtgaacacaaaacttatttaaagatgctttatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgttattttaaaaatgaaatatttcaaagactgaatattttcaaagaaaatgaataattcattgcccttgtgatttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttgccttaccagtgaaaaaggtgcactgaggtaacatctaaaacagagatgtggttcttaatgtttaacagaacagttctaatcctgccacgtgttatcattatagattttatagttgcctttctaactacttagcacagtttgagaatacgttaattgctatttactatttaaaaagttttactgaaatcagtccataacattaagatgagccctaatatgtaagattttcctctggaatggatgtgagaaatgtaaattttataacagcagtatttatcctggtttaattctaatacgatgtcatgttaatttcatgttgtgattaataaaagcattttttcttca

SEQ ID NO: 288084 - DNA, 1558 bp, Homo sapiens
acaggaagcgggcgcgcgacggctcctccgggcagcgcagcgcgggcgcctcttccactgtgaccacgggcgcgcgggccaagggggcgcggcggggcctcccgggctgatcggccgaagcccgggccccgcgcggcctctggcgggctgacgccgggaggaggggcgggggctggccagatgactgtatctatgcaaaggcggaggcggtgggcggggagggggctggattcagtagagggcaaggggcactcacatccccggcgcgccactcgcggggctcctttctgcacgtgccccgggcctctcccgctcgctcaacctgtctgcggagggcgcgctctcgcgcaccctgctcccgcgttcgcttctttgttcccgcccacgcgaggcccattttgacggatccagttcgaggcctgacggcggccaatcggcgctggcgccttcaccctccccgccccgccgaacccgtcaagggccgccccttttcctgcccacgtggtctcgggctcctgccccgtcctgctcacgagttcagggctcctgggcggccgccttttccagttccaggtgtgcagaagtgtcctctccccacgcgcggcgggctgcacttggtcgctggctccgagatcgcgcggggccgccggaagcccaagacggtaccgggggccgcagccgcagccggcgccgccctccgccctccccaacagcaggccgagtcccgtagcatccggtagggaaatggtcgtgctttcggtccccgccgaagtcaccgtgatcctgttagatatcgaaggtaccacaaccccgattgctttcgtgaaggacattttatttccttacatcgaagaaaatgttaaagagtatctgcagacacattgggaagaagaggagtgccagcaggatgtcagtcttttgaggaaacaggctgaagaggacgcccacctggatggggctgttcctatccctgcagcatctgggaatggagtggatgatctgcaacagatgatccaggccgtggtagataatgtgtgctggcagatgtccctggatcgaaagaccactgcactcaaacagctgcagggccacatgtggagggcggcattcacagctgggcgcatgaaagcagagttctttgcagatgtagttccagcagtcaggaagtggagagaggccggaatgaaggtgtacatctattcctcagggagtgtggaggcacagaaactgttattcgggcattctacggagggagatattcttgagcttgttgatggtcactttgataccaagattggacacaaagtagagagtgaaagttaccgaaagattgcagacagcattgggtgctcaaccaacaacattttgtttctgacagatgttactcgaggtgagtaatagacttcttatattatatactccaggatatgaactgagcctggcactacaaatacattgcctctttaaagaaactttatatggggatccttgaaaaataaaacagttttacggttttatataaagaaacagtgtctggttcaagttcatgtttgaatta

SEQ ID NO: 288085 - DNA, 1061 bp, Homo sapiens
acaggaagcgggcgcgcgacggctcctccgggcagcgcagcgcgggcgcctcttccactgtgaccacgggcgcgcgggccaagggggcgcggcggggcctcccgggctgatcggccgaagcccgggccccgcgcggcctctggcgggctgacgccgggaggaggggcgggggctggccagatgactgtatctatgcaaaggcggaggcggtgggcggggagggggctggattcagtagagggcaaggggcactcacatccccggcgcgccactcgcggggctcctttctgcacgtgccccgggcctctcccgctcgctcaacctgtctgcggagggcgcgctctcgcgcaccctgctcccgcgttcgcttctttgttcccgcccacgcgaggcccattttgacggatccagttcgaggcctgacggcggccaatcggcgctggcgccttcaccctccccgccccgccgaacccgtcaagggccgccccttttcctgcccacgtggtctcgggctcctgccccgtcctgctcacgagttcagggctcctgggcggccgccttttccagttccaggtgtgcagaagtgtcctctccccacgcgcggcgggctgcacttggtcgctggctccgagatcgcgcggggccgccggaagcccaagacggtaccgggggccgcagccgcagccggcgccgccctccgccctccccaacagcaggccgagtcccgtagcatccggtagggaaatggtcgtgctttcggtccccgccgaagtcaccgtgatcctgttagatatcgaaggtaccacaaccccgattgctttcgtgaaggacattttatttccttacatcgaagaaaatgttaaagagtatctgcagacacattgggaagaagaggagtgccagcaggatgtcagtcttttgaggaaacaggctgaagaggacgcccacctggatggggctgttcctatccctgcagcatctgggaatggagtggatgatctgcaacagatgatccaggccgtggtagataatgtgtgcagtctgggcactcggcgtgtgca

SEQ ID NO: 288086 - DNA, 672 bp, Homo sapiens
ggaactagccttagcgaggccatgggggaaaaagtctaactggcggaactcctgggaactggggcgatgggctcttagtatcggaggattggagccatctgatttttacctgaaattccttagtctctcctgtgttggggaaatggtcaccttgccttcagggacctgggctttcagctgtccatacctggccctggttgatggcggcatgctgggcagtgcacgtgaagacgcacatgagacagcatctcgtatgttgcccaggctggccttgaaagcctggcctcaagccatcttcctgcctcagcctcccaagtagctgggatcacagggttgtggcatcacagctggctatattcttaacattattttgtaaccattccaacccccagaaatttctctctggctgacttgatccacagcgcctccatcgccatccctgagtgccttgttgtggaaaatcttactttatcttggttctgtttggtataatcggggaaagtctgtattctttcattatgtaaaacaacttatctctcattgtttcatctcctttctgagctctgctctgccagctctctttccaaaaccaaaatggctcttcaagttattttgtaaataataatgggccatctacttcttaacataaatgaatgattttccaaggtcaag

SEQ ID NO: 288087 - DNA, 836 bp, Homo sapiens
ggaactagccttagcgaggccatgggggaaaaagtctaactggcggaactcctgggaactggggcgatgggctcttagtatcggaggattggagccatctgatttttacctgaaattccttagtctctcctgtgttggggaaatgagaccgggacttgctgtgttgcccaggctggtcttgaactcctggtcttaagcaatcatactgctttggccacccaaagcactgggattacaggcgtgaaccaccacacccagctcttaaaaccacagtatttctaggtcagtataacacacctgccccagggacttacaggtgtggcagaagcttggacttctggcttttctctctcttgcacccaggcacgctgcagctaccatttcctcccttcactacgttttagattctttccttttcattcctgtcattaccatgctaacgtacatctctatccaccttgctgttgggcaggtatgagcggcttgctggctgttcttccttgccttttggtctgtttctacttagctgactcctcaattgggtagaaacattcttcatcaatactatactgttataggctgtcccttgtgatttcaaactctagtaccagatactgttctctggttggttcttatgggcatcacttgtttttctggctaaatactagatctaaggtaggaatatggcttttgttttactagcagtgttcaagccctactgtgagcgcactgctagactgtcagatctctgagaatttcagaggattcctatataatgttaagtgactaaacttaataaacttaattaaaatcaacatctcaagatattgaaaaaa

SEQ ID NO: 288088 - DNA, 945 bp, Homo sapiens
aagcctggtcgcgctagctgggtaacctcgagggatactctaagagcaaagttactggcggaactcctgggaactggggcgatgggctcttagtatcggaggattggagccatctgatttttacctgaaattccttagtctctcctgtgttggggaaatggtcaccttgccttcagggacctgggctttcagctgtccatacctggccctggttgatggcggcatgctgggcagtgcacgtgaagacgcacatgagaccgggacttgctgtgttgcccaggctggtcttgaactcctggtcttaagcaatcatactgctttggccacccaaagcactgggattacaggcgtgaaccaccacacccagctcttaaaaccacagtatttctaggtcagtataacacacctgccccagggacttacaggtgtggcagaagcttggacttctggcttttctctctcttgcacccaggcacgctgcagctaccatttcctcccttcactacgttttagattctttccttttcattcctgtcattaccatgctaacgtacatctctatccaccttgctgttgggcaggtatgagcggcttgctggctgttcttccttgccttttggtctgtttctacttagctgactcctcaattgggtagaaacattcttcatcaatactatactgttataggctgtcccttgtgatttcaaactctagtaccagatactgttctctggttggttcttatgggcatcacttgtttttctggctaaatactagatctaaggtaggaatatggcttttgttttactagcagtgttcaagccctactgtgagcgcactgctagactgtcagatctctgagaatttcagaggattcctatataatgttaagtgactaaacttaataaacttaattaaaatcaacatctcaagatattgaaaaaa

SEQ ID NO: 288089 - DNA, 930 bp, Homo sapiens
ggaactagccttagcgaggccatgggggaaaaagtctaactggcggaactcctgggaactggggcgatgggctcttagtatcggaggattggagccatctgatttttacctgaaattccttagtctctcctgtgttggggaaatggtcaccttgccttcagggacctgggctttcagctgtccatacctggccctggttgatggcggcatgctgggcagtgcacgtgaagacgcacatgagaccgggacttgctgtgttgcccaggctggtcttgaactcctggtcttaagcaatcatactgctttggccacccaaagcactgggattacaggcgtgaaccaccacacccagctcttaaaaccacagtatttctaggtcagtataacacacctgccccagggacttacaggtgtggcagaagcttggacttctggcttttctctctcttgcacccaggcacgctgcagctaccatttcctcccttcactacgttttagattctttccttttcattcctgtcattaccatgctaacgtacatctctatccaccttgctgttgggcaggtatgagcggcttgctggctgttcttccttgccttttggtctgtttctacttagctgactcctcaattgggtagaaacattcttcatcaatactatactgttataggctgtcccttgtgatttcaaactctagtaccagatactgttctctggttggttcttatgggcatcacttgtttttctggctaaatactagatctaaggtaggaatatggcttttgttttactagcagtgttcaagccctactgtgagcgcactgctagactgtcagatctctgagaatttcagaggattcctatataatgttaagtgactaaacttaataaacttaattaaaatcaacatctcaagatattgaaaaaa

SEQ ID NO: 288090 - DNA, 902 bp, Homo sapiens
ggaactagccttagcgaggccatgggggaaaaagtctaactggcggaactcctgggaactggggcgatgggctcttagtatcggaggattggagccatctgatttttacctgaaattccttagtctctcctgtgttggggaaatgtcccctctcaccatgtctggctggcggcgactcagatgccatgagatggccatttgaagacaggcctgccggacatcaggtcaccttgccttcagggacctgggctttcagctgtccatacctggccctggttgatggcggcatgctgggcagtgcacgtgaagacgcacatgagaccgggacttgctgtgttgcccaggctggtcttgaactcctggtcttaagcaatcatactgctttggccacccaaagcactgggattacaggcgtgaaccaccacacccagctcttaaaaccacagtatttctagcacaggactgcaccaaggggcaacgcagtactgcagccttcctctgactcagtttggattctctctgtccgttctcaccacactactaaggagagaacagtgccaggcaggggaaggagaggtacctgaagttctttctccagttgagcccgaagctcttccatccctgagggcagcactagcctggagggcagagaggtcgagcgtctcaacagcatggggttggcaccattgaggaactggtagctgaacaactcatcatcctgccagcactggcgaaccttctctttggtgggcggtgaaaggaggatatatgtaccacagcctgcatatcccttctccaaaatctaccccaggggttcaggtatataaccctccctgaacccagcttctgcgttttcattctcaaggcctctctgagttgaccagatatgataaggtctcttc

SEQ ID NO: 288091 - DNA, 598 bp, Homo sapiens
ctaagtcaatgttatgattccatgctgcaaacaaggaaattaagcctcagcaatcctgatattctggaacagaacaatcctttaagagatttggtattgaagaccttgttggaaatggatcagacattgcccagaccactgtccagacccaacactggaataacccaggagagcttcgtgcttacctcccatcggcggtcattggtgaaaatctcatcattggctaagtccagctggttccactccagcagaagcttcagctgcccattccagttatccttgtcttgctcactggtgctgaaggctgtgagagggcaggaaaagactcaactcaccaaaggctcagaaataagagtgagaaccattcagtgtggccaattatcagagctgtttatcacagatcgtatttgttcttaaatggtatctaccagaagaagacagccagcttttgatactaacaaaccacaatggaagatggccgtatttatcattgcctttagcatgttaaagggtacataccacattgaccctggcagaagcattcctgatgtgttggaaaaattaagagaaataacagttctttggcaataaaaatacc

SEQ ID NO: 288092 - DNA, 4280 bp, Homo sapiens
atgcgcccagctcttggaggtaagcggctgtgtgcgggtggtcgcggtgagtgtgcaaggccgcggtggccgcgtgacaagcctgcgctaccagtgcgcccgccggccaggagaacggagcttgtgatagatcctttcgtaacaccaagtattgtaccaggacctgcggctccgccccagaggccgccatcttcctgaccacccgaaaggccggacctactccccggtgcatcttgggatcagggcggggccctgagcgccgccatgcttttgtacggcaggatcgcaaagcacgccgggaccggttggtttggttttgaagacgtggatggcgggaattctcgcttctggcctgggtgttttagctcacttggaaaggctagagacccaagtgagcagatcccgtaaacagtctgaagagctgcagagcgtgcaggcccaggaaggtgctcttggaaccaagattcataaactaaggcgtctgcgagatgagctgagggctgtggtgcggcaccggcgagccagcgtgaaagcatgtattgccaatgtagaacccaaccaaacagtggagatcaatgagcaagaagcattggaagagaaattggaaaatgtgaaagccattctgcaggcatatcattttacaggcctcagtggtaaactgaccagccgaggagtttgtgtctgcatcagtactgcttttgaggggaacctattggattcctattttgtggaccttgtcatacagaaaccactccggatacatcaccattcagtcccagtcttcattcccctggaagagatagctgcaaaatatttacagaccaacatccagcacttcctgttcagtctctgcgagtacctgaatgcttactctgggaggaagtaccaggcagaccggcttcagagtgactttgcagccctcctgactgggcccttgcagagaaacccactgtgtaacttgctgtcatttacttacaaactggatccagggggtcagtccttcccgttctgtgctagattgctgtataaggacctcacagcaactcttcccactgacgtcaccgtgacatgtcaaggagtggaagtattatccacttcatgggaggagcaacgagcatctcatgaaactctgttctgtacgaagcccttgcatcaagtgtttgcctcatttacaagaaaaggagaaaagttggatatgagtctggtctcctaatagattgttttcactgcactgggagcacatcagagaaataaatcccccctcccctgccaggtgaaaggaaatattgcactttctgttctcatgactaaggggacaggagttccagaagaacctttcaagatgatcaggaacaccaggacgagggccgtctcacctcactcggaccacatggagacctcccttcaaaatgggagccatgtcctgccccaccaagccctgtctgaagtggagcttccccgcctgtgctccctccacagtcccggaaagcccagcggcaaaggcagctttgtcccagctctgccaccctcctgctcacagtggtcagggcccctcaggggcaaggacggcagggattggaacgagggctctggaaggactgttcagccctatgcctaagacccctatgctggggacactacaggcacacagaggaatagcagggccaccctcagagctcacacatccacgaacaaatgaaggctgaggaggtttctaaacctaaagtccatgagtgtgcacttcaatccaggaaggtcgggacttccttcagtttcaaaaaataaattctcccttccggtttggactgttgcaggctcgaggccattcaggagttgtccaccacctggtggggcagtgtgacagaggggccattggggaaggtggctagcttatcccgccccttcaagaagaaggtcagcagctcccccttccccttcacaaagatggggcctcgcctcacaaagcggaagccgtactctcggaggatgacttgggtttcttctaccacctggagagggagggggagcaagaacgtggcgttacggggggagcctagactgagggcgggtgggggctttgggtggttggagccgagcactgatccatgggtcccaagcagtacgggacactccccaaacctcccagggccaagcccttccacccgtggcgagcagcgggtgggaaggagaaccctggagtgactggctgggggcctcctctcatccagagacttctctcctaggatggccatggtcacctgggtggcagcactgttacctggaaactgccactgcctgctcttctgtccctttgcccctttcgtggagcttttctgccagacgccactgagacagatcacaaggtattagaaggttcatacccaaaggtaggccatatgcatctagaacttcagcccagattttgtggatgggtggaagtgtttcttcctgtgctgaggctagctattgcagagattcttttccacttgccccacgtctctgcctctggacttactgttcagggccagggtgggaggcaggggcacgtgggaaagcactgttccggttttgttctcatgccgagtctgagcacgtgccagctgtgccactggacatacctgaatgttgcccatgacccccgtggactccatcctgctggctacattgactgtattgccccagatgtcgtagtgtggtttccgggctccgatgaccccagccagaaccccgcctttgttcatgcctagggtagaggcataaagttcagcacagccacaggccacaccttgttatgggcctcagaagccatctcctctccagacctgtaccacaaagctcctaatgtaacacatcattgtcctcattcaacttggctgtatgctattggagggtggaaatcacatctcctgtttatccgtgtgcttgttaggtgtcagccgccaccccccccccatatgcagatttactcggcatggtagtggccagcttctaacacagctggtatttcaagtctcctgggacctcactcaggaatgataccccctcagtagaagcagcaggtgatcttaactcctttcaaagagcaggcctgtctgggaagccatgtcctcagcaggcacagcaacccctctggaaatggatcacaaactcacttctcagccaggcaggccaagcttctattgtaacagtaggcacagtatagtcggatcatcacatcagctgggtttttggtttagtcatctagagtcgtctggactaaaggtctttcaggtctccttgccctgtgagtgcgtgaacctccccacccgaattgcctcagttgtcctgagcctcatgtctctcctggtggtgggccaggcccctgcatgggaagggagcctgctgcggggcaggccagctgggggtgctcacctatgcgcagcatgaagttattgaaggactggttgttgatgttggtgagcgtatccttcatggccagcgcgaagtcggccaggtcagccaggtgctgccagcgctctctctcggacttgtcttcctgtgccaggggaccgtggagaaagtgtcaggggccgctcactgcagcagcctgctctgctgccttccctggcagtgttctgggggtggattccctacacctagatgttcaaggccttacttttcctcccacaaaggagtcgcagccacgctagctctgacttgccactgtgacaaagttcacgtagcaggtctaggcaaagactgggcaattgagcagaggagacggacctgtgagtctgaccacgaggcggaccccttcaccttggctgggcctggtcctggtccttaggttttgtcaggttgtccttgtttggatccctcaactaggtgataagcactggagggggatgacccgccttggacgtgtttctttaacctcatccatataatagggccgtgggatggttgtagaggtaaagcaggatgatggtgttttaagaccagagcttgggaccagggctcctacacctaattttctctcctggtagctgaacaaaggtctaaattagcttaacaaaagaacaggctgccgtcagccagagttctgaaggccatgctttcagtttcccttgttgacaattgctctccagttcctatgaaagcacagagccttagggggcctggccacagaacacaaccatcttaggcctgagctgtgaacagcagggggttgtgtgtctgttctgtttctctgcttgccgaactttctcaataaaccctatttcttatttataaaaaaatgg

SEQ ID NO: 288093 - DNA, 1056 bp, Homo sapiens
atgcgcccagctcttggaggtaagcggctgtgtgcgggtggtcgcggtgagtgtgcaaggccgcggtggccgcgtgacaagcctgcgctaccagtgcgcccgccggccaggagaacggagcttgtgatagatcctttcgtaacaccaagtattgtaccaggacctgcggctccgccccagaggccgccatcttcctgaccacccgaaaggccggacctactccccggtgcatcttgggatcagggcggggccctgagcgccgccatgcttttgtacggcaggatcgcaaagcacgccgggaccggttggtttggttttgaagacgtggatggcgggaattctcgcttctggcctggcaaggacattggagtccctatcaccggttgcctagacaacttcatgggaaggcccttgggaatctgagatggagcaggcgaaccctttacgtccagatggcgagtccaaaggaggtgttttagctcacttggaaaggctagagacccaagtgagcagatcccgtaaacagtctgaagagctgcagagcgtgcaggcccaggaaggtgctcttggaaccaagattcataaactaaggcgtctgcgagatgagctgagggctgtggtgcggcaccggcgagccagcgtgaaagcatgtattgccaatgtagaacccaaccaaacagtggagatcaatgagcaagaagcattggaagagaaattggaaaatgtgaaagccattctgcaggcatatcattttacaggtttgtttgtttttttaacctaatttagtctgggtctgcctctagtgagttagtttgtagatgtgttatcagtcctggaattatttcataatttatagtattttacaccctctgccctcatcactcacacaaaaaaacagacacacacacagctgacgtgctatttgtaggcctatcttcacctacaagatgtgattggcccttttgtacagagtcagttggtgggtggttattccatcatcttaacagttcgtcatgtgccagaccttgtactagaactgtctttactgctggcttg

SEQ ID NO: 288094 - DNA, 4413 bp, Homo sapiens
atgcgcccagctcttggaggtaagcggctgtgtgcgggtggtcgcggtgagtgtgcaaggccgcggtggccgcgtgacaagcctgcgctaccagtgcgcccgccggccaggagaacggagcttgtgatagatcctttcgtaacaccaagtattgtaccaggacctgcggctccgccccagaggccgccatcttcctgaccacccgaaaggccggacctactccccggtgcatcttgggatcagggcggggccctgagcgccgccatgcttttgtacggcaggatcgcaaagcacgccgggaccggttggtttggttttgaagacgtggatggcgggaattctcgcttctggcctgggtgagctagaagggagaagcaaggacattggagtccctatcaccggttgcctagacaacttcatgggaaggcccttgggaatctgagatggagcaggcgaaccctttacgtccagatggcgagtccaaaggaggtgttttagctcacttggaaaggctagagacccaagtgagcagatcccgtaaacagtctgaagagctgcagagcgtgcaggcccaggaaggtgctcttggaaccaagattcataaactaaggcgtctgcgagatgagctgagggctgtggtgcggcaccggcgagccagcgtgaaagcatgtattgccaatgtagaacccaaccaaacagtggagatcaatgagcaagaagcattggaagagaaattggaaaatgtgaaagccattctgcaggcatatcattttacaggcctcagtggtaaactgaccagccgaggagtttgtgtctgcatcagtactgcttttgaggggaacctattggattcctattttgtggaccttgtcatacagaaaccactccggatacatcaccattcagtcccagtcttcattcccctggaagagatagctgcaaaatatttacagaccaacatccagcacttcctgttcagtctctgcgagtacctgaatgcttactctgggaggaagtaccaggcagaccggcttcagagtgactttgcagccctcctgactgggcccttgcagagaaacccactgtgtaacttgctgtcatttacttacaaactggatccagggggtcagtccttcccgttctgtgctagattgctgtataaggacctcacagcaactcttcccactgacgtcaccgtgacatgtcaaggagtggaagtattatccacttcatgggaggagcaacgagcatctcatgaaactctgttctgtacgaagcccttgcatcaagtgtttgcctcatttacaagaaaaggagaaaagttggatatgagtctggtctcctaatagattgttttcactgcactgggagcacatcagagaaataaatcccccctcccctgccaggtgaaaggaaatattgcactttctgttctcatgactaaggggacaggagttccagaagaacctttcaagatgatcaggaacaccaggacgagggccgtctcacctcactcggaccacatggagacctcccttcaaaatgggagccatgtcctgccccaccaagccctgtctgaagtggagcttccccgcctgtgctccctccacagtcccggaaagcccagcggcaaaggcagctttgtcccagctctgccaccctcctgctcacagtggtcagggcccctcaggggcaaggacggcagggattggaacgagggctctggaaggactgttcagccctatgcctaagacccctatgctggggacactacaggcacacagaggaatagcagggccaccctcagagctcacacatccacgaacaaatgaaggctgaggaggtttctaaacctaaagtccatgagtgtgcacttcaatccaggaaggtcgggacttccttcagtttcaaaaaataaattctcccttccggtttggactgttgcaggctcgaggccattcaggagttgtccaccacctggtggggcagtgtgacagaggggccattggggaaggtggctagcttatcccgccccttcaagaagaaggtcagcagctcccccttccccttcacaaagatggggcctcgcctcacaaagcggaagccgtactctcggaggatgacttgggtttcttctaccacctggagagggagggggagcaagaacgtggcgttacggggggagcctagactgagggcgggtgggggctttgggtggttggagccgagcactgatccatgggtcccaagcagtacgggacactccccaaacctcccagggccaagcccttccacccgtggcgagcagcgggtgggaaggagaaccctggagtgactggctgggggcctcctctcatccagagacttctctcctaggatggccatggtcacctgggtggcagcactgttacctggaaactgccactgcctgctcttctgtccctttgcccctttcgtggagcttttctgccagacgccactgagacagatcacaaggtattagaaggttcatacccaaaggtaggccatatgcatctagaacttcagcccagattttgtggatgggtggaagtgtttcttcctgtgctgaggctagctattgcagagattcttttccacttgccccacgtctctgcctctggacttactgttcagggccagggtgggaggcaggggcacgtgggaaagcactgttccggttttgttctcatgccgagtctgagcacgtgccagctgtgccactggacatacctgaatgttgcccatgacccccgtggactccatcctgctggctacattgactgtattgccccagatgtcgtagtgtggtttccgggctccgatgaccccagccagaaccccgcctttgttcatgcctagggtagaggcataaagttcagcacagccacaggccacaccttgttatgggcctcagaagccatctcctctccagacctgtaccacaaagctcctaatgtaacacatcattgtcctcattcaacttggctgtatgctattggagggtggaaatcacatctcctgtttatccgtgtgcttgttaggtgtcagccgccaccccccccccatatgcagatttactcggcatggtagtggccagcttctaacacagctggtatttcaagtctcctgggacctcactcaggaatgataccccctcagtagaagcagcaggtgatcttaactcctttcaaagagcaggcctgtctgggaagccatgtcctcagcaggcacagcaacccctctggaaatggatcacaaactcacttctcagccaggcaggccaagcttctattgtaacagtaggcacagtatagtcggatcatcacatcagctgggtttttggtttagtcatctagagtcgtctggactaaaggtctttcaggtctccttgccctgtgagtgcgtgaacctccccacccgaattgcctcagttgtcctgagcctcatgtctctcctggtggtgggccaggcccctgcatgggaagggagcctgctgcggggcaggccagctgggggtgctcacctatgcgcagcatgaagttattgaaggactggttgttgatgttggtgagcgtatccttcatggccagcgcgaagtcggccaggtcagccaggtgctgccagcgctctctctcggacttgtcttcctgtgccaggggaccgtggagaaagtgtcaggggccgctcactgcagcagcctgctctgctgccttccctggcagtgttctgggggtggattccctacacctagatgttcaaggccttacttttcctcccacaaaggagtcgcagccacgctagctctgacttgccactgtgacaaagttcacgtagcaggtctaggcaaagactgggcaattgagcagaggagacggacctgtgagtctgaccacgaggcggaccccttcaccttggctgggcctggtcctggtccttaggttttgtcaggttgtccttgtttggatccctcaactaggtgataagcactggagggggatgacccgccttggacgtgtttctttaacctcatccatataatagggccgtgggatggttgtagaggtaaagcaggatgatggtgttttaagaccagagcttgggaccagggctcctacacctaattttctctcctggtagctgaacaaaggtctaaattagcttaacaaaagaacaggctgccgtcagccagagttctgaaggccatgctttcagtttcccttgttgacaattgctctccagttcctatgaaagcacagagccttagggggcctggccacagaacacaaccatcttaggcctgagctgtgaacagcagggggttgtgtgtctgttctgtttctctgcttgccgaactttctcaataaaccctatttcttatttataaaaaaatgg

SEQ ID NO: 288095 - DNA, 4293 bp, Homo sapiens
atgcgcccagctcttggaggtaagcggctgtgtgcgggtggtcgcggtgagtgtgcaaggccgcggtggccgcgtgacaagcctgcgctaccagtgcgcccgccggccaggagaacggagcttgtgatagatcctttcgtaacaccaagtattgtaccaggacctgcggctccgccccagaggccgccatcttcctgaccacccgaaaggccggacctactccccggtgcatcttgggatcagggcggggccctgagcgccgccatgcttttgtacggcaggatcgcaaagcacgccgggaccggttggtttggttttgaagacgtggatggcgggaattctcgcttctggcctggcaaggacattggagtccctatcaccggttgcctagacaacttcatgggaaggcccttgggaatctgagatggagcaggcgaaccctttacgtccagatggcgagtccaaaggaggtgttttagctcacttggaaaggctagagacccaagtgagcagatcccgtaaacagtctgaagagctgcagagcgtgcaggcccaggaaggtgctcttggaaccaagattcataaactaaggcgtctgcgagatgagctgagggctgtggtgcggcaccggcgagccagcgtgaaagcatgtattgccaatgtagaacccaaccaaacagtggagatcaatgagcaagaagcattggaagagaaattggaaaatgtgaaagccattctgcaggcatatcattttacagaaaccactccggatacatcaccattcagtcccagtcttcattcccctggaagagatagctgcaaaatatttacagaccaacatccagcacttcctgttcagtctctgcgagtacctgaatgcttactctgggaggaagtaccaggcagaccggcttcagagtgactttgcagccctcctgactgggcccttgcagagaaacccactgtgtaacttgctgtcatttacttacaaactggatccagggggtcagtccttcccgttctgtgctagattgctgtataaggacctcacagcaactcttcccactgacgtcaccgtgacatgtcaaggagtggaagtattatccacttcatgggaggagcaacgagcatctcatgaaactctgttctgtacgaagcccttgcatcaagtgtttgcctcatttacaagaaaaggagaaaagttggatatgagtctggtctcctaatagattgttttcactgcactgggagcacatcagagaaataaatcccccctcccctgccaggtgaaaggaaatattgcactttctgttctcatgactaaggggacaggagttccagaagaacctttcaagatgatcaggaacaccaggacgagggccgtctcacctcactcggaccacatggagacctcccttcaaaatgggagccatgtcctgccccaccaagccctgtctgaagtggagcttccccgcctgtgctccctccacagtcccggaaagcccagcggcaaaggcagctttgtcccagctctgccaccctcctgctcacagtggtcagggcccctcaggggcaaggacggcagggattggaacgagggctctggaaggactgttcagccctatgcctaagacccctatgctggggacactacaggcacacagaggaatagcagggccaccctcagagctcacacatccacgaacaaatgaaggctgaggaggtttctaaacctaaagtccatgagtgtgcacttcaatccaggaaggtcgggacttccttcagtttcaaaaaataaattctcccttccggtttggactgttgcaggctcgaggccattcaggagttgtccaccacctggtggggcagtgtgacagaggggccattggggaaggtggctagcttatcccgccccttcaagaagaaggtcagcagctcccccttccccttcacaaagatggggcctcgcctcacaaagcggaagccgtactctcggaggatgacttgggtttcttctaccacctggagagggagggggagcaagaacgtggcgttacggggggagcctagactgagggcgggtgggggctttgggtggttggagccgagcactgatccatgggtcccaagcagtacgggacactccccaaacctcccagggccaagcccttccacccgtggcgagcagcgggtgggaaggagaaccctggagtgactggctgggggcctcctctcatccagagacttctctcctaggatggccatggtcacctgggtggcagcactgttacctggaaactgccactgcctgctcttctgtccctttgcccctttcgtggagcttttctgccagacgccactgagacagatcacaaggtattagaaggttcatacccaaaggtaggccatatgcatctagaacttcagcccagattttgtggatgggtggaagtgtttcttcctgtgctgaggctagctattgcagagattcttttccacttgccccacgtctctgcctctggacttactgttcagggccagggtgggaggcaggggcacgtgggaaagcactgttccggttttgttctcatgccgagtctgagcacgtgccagctgtgccactggacatacctgaatgttgcccatgacccccgtggactccatcctgctggctacattgactgtattgccccagatgtcgtagtgtggtttccgggctccgatgaccccagccagaaccccgcctttgttcatgcctagggtagaggcataaagttcagcacagccacaggccacaccttgttatgggcctcagaagccatctcctctccagacctgtaccacaaagctcctaatgtaacacatcattgtcctcattcaacttggctgtatgctattggagggtggaaatcacatctcctgtttatccgtgtgcttgttaggtgtcagccgccaccccccccccatatgcagatttactcggcatggtagtggccagcttctaacacagctggtatttcaagtctcctgggacctcactcaggaatgataccccctcagtagaagcagcaggtgatcttaactcctttcaaagagcaggcctgtctgggaagccatgtcctcagcaggcacagcaacccctctggaaatggatcacaaactcacttctcagccaggcaggccaagcttctattgtaacagtaggcacagtatagtcggatcatcacatcagctgggtttttggtttagtcatctagagtcgtctggactaaaggtctttcaggtctccttgccctgtgagtgcgtgaacctccccacccgaattgcctcagttgtcctgagcctcatgtctctcctggtggtgggccaggcccctgcatgggaagggagcctgctgcggggcaggccagctgggggtgctcacctatgcgcagcatgaagttattgaaggactggttgttgatgttggtgagcgtatccttcatggccagcgcgaagtcggccaggtcagccaggtgctgccagcgctctctctcggacttgtcttcctgtgccaggggaccgtggagaaagtgtcaggggccgctcactgcagcagcctgctctgctgccttccctggcagtgttctgggggtggattccctacacctagatgttcaaggccttacttttcctcccacaaaggagtcgcagccacgctagctctgacttgccactgtgacaaagttcacgtagcaggtctaggcaaagactgggcaattgagcagaggagacggacctgtgagtctgaccacgaggcggaccccttcaccttggctgggcctggtcctggtccttaggttttgtcaggttgtccttgtttggatccctcaactaggtgataagcactggagggggatgacccgccttggacgtgtttctttaacctcatccatataatagggccgtgggatggttgtagaggtaaagcaggatgatggtgttttaagaccagagcttgggaccagggctcctacacctaattttctctcctggtagctgaacaaaggtctaaattagcttaacaaaagaacaggctgccgtcagccagagttctgaaggccatgctttcagtttcccttgttgacaattgctctccagttcctatgaaagcacagagccttagggggcctggccacagaacacaaccatcttaggcctgagctgtgaacagcagggggttgtgtgtctgttctgtttctctgcttgccgaactttctcaataaaccctatttcttatttataaaaaaatgg

SEQ ID NO: 288096 - DNA, 1162 bp, Homo sapiens
atgcgcccagctcttggaggtaagcggctgtgtgcgggtggtcgcggtgagtgtgcaaggccgcggtggccgcgtgacaagcctgcgctaccagtgcgcccgccggccaggagaacggagcttgtgatagatcctttcgtaacaccaagtattgtaccaggacctgcggctccgccccagaggccgccatcttcctgaccacccgaaaggccggacctactccccggtgcatcttgggatcagggcggggccctgagcgccgccatgcttttgtacggcaggatcgcaaagcacgccgggaccggttggtttggttttgaagacgtggatggcgggaattctcgcttctggcctgggtgttttagctcacttggaaaggctagagacccaagtgagcagatcccgtaaacagtctgaagagctgcagagcgtgcaggcccaggaaggtgctcttggaaccaagattcataaactaaggcgtctgcgagatgagctgagggctgtggtgcggcaccggcgagccagcgtgaaagcatgtattgccaatgtagaacccaaccaaacagtggagatcaatgagcaagaagcattggaagagaaattggaaaatgtgaaagccattctgcaggcatatcattttacaggcctcagtggtaaactgaccagccgaggagtttgtgtctgcatcagtactgcttttgaggggaacctattggattcctattttgtggaccttgtcatacagaaaccactccggatacatcaccattcagtcccagtcttcattcccctggaagagatagctgcaaaatatttacagaccaacatccagcacttcctgttcagtctctgcgagtacctgaatgcttactctgggaggaagtaccaggcagaccggcttcagagtgactttgcagccctcctgactgggcccttgcagagaaacccactgtgtaacttgctgtcatttacttacaaactggatccagggggtcagtccttcccgttctgtgctagattgctgtataaggacctcacagcaactcttcccactttggtgttaccctggcacaggttacgggaatgtaagtaataattcactgcttggataggagcctccttcctgtttcaggaaacatttgttctgttctgaagcactttg

SEQ ID NO: 288097 - DNA, 1943 bp, Homo sapiens
atgcgcccagctcttggaggtaagcggctgtgtgcgggtggtcgcggtgagtgtgcaaggccgcggtggccgcgtgacaagcctgcgctaccagtgcgcccgccggccaggagaacggagcttgtgatagatcctttcgtaacaccaagtattgtaccaggacctgcggctccgccccagaggccgccatcttcctgaccacccgaaaggccggacctactccccggtgcatcttgggatcagggcggggccctgagcgccgccatgcttttgtacggcaggatcgcaaagcacgccgggaccggttggtttggttttgaagacgtggatggcgggaattctcgcttctggcctgggtgagctagaagggagaagcaaggacattggagtccctatcaccggttgcctagacaacttcatgggaaggcccttgggaatctgagatggagcaggcgaaccctttacgtccagatggcgagtccaaaggaggtgttttagctcacttggaaaggctagagacccaagtgagcagatcccgtaaacagtctgaagagctgcagagcgtgcaggcccaggaaggtgctcttggaaccaagattcataaactaaggcgtctgcgagatgagctgagggctgtggtgcggcaccggcgagccagcgtgaaagcatgtattgccaatgtagaacccaaccaaacagtggagatcaatgagcaagaagcattggaagagaaattggaaaatgtgaaagccattctgcaggcatatcattttacaggcctcagtggtaaactgaccagccgaggagtttgtgtctgcatcagtactgcttttgaggggaacctattggattcctattttgtggaccttgtcatacagaaaccactccggatacatcaccattcagtcccagtcttcattcccctggaagagatagctgcaaaatatttacagaccaacatccagcacttcctgttcagtctctgcgagtacctgaatgcttactctgggaggaagtaccaggcagaccggcttcagagtgactttgcagccctcctgactgggcccttgcagagaaacccactgtgtaacttgctgtcatttacttacaaactggatccagggggtcagtccttcccgttctgtgctagattgctgtataaggacctcacagcaactcttcccactgacgtcaccgtgacatgtcaaggagtggaagtattatccacttcatgggaggagcaacgagcatctcatgaaactctgttctgtacgaagcccttgcatcaagtgtttgcctcatttacaagaaaaggagaaaagttggatatgagtctggtctcctaatagattgttttcactgcactgggagcacatcagagaaataaatcccccctcccctgccaggtgaaaggaaatattgcactttctgttctcatgactaaggggacaggagttccagaagaacctttcaagatgatcaggaacaccaggacgagggccgtctcacctcactcggaccacatggagacctcccttcaaaatgggagccatgtcctgccccaccaagccctgtctgaagtggagcttccccgcctgtgctccctccacagtcccggaaagcccagcggcaaaggcagctttgtcccagctctgccaccctcctgctcacagtggtcagggcccctcaggggcaaggacggcagggattggaacgagggctctggaaggactgttcagccctatgcctaagacccctatgctggggacactacaggcacacagaggaatagcagggccaccctcagagctcacacatccacgaacaaatgaaggctgaggaggtttctaaacctaaagtccatgagtgtgcacttcaatccaggaaggtcgggacttccttcagtttcaaaaaataaattctcccttccggtttggactgtt

SEQ ID NO: 288098 - DNA, 4394 bp, Homo sapiens
atgcgcccagctcttggaggtaagcggctgtgtgcgggtggtcgcggtgagtgtgcaaggccgcggtggccgcgtgacaagcctgcgctaccagtgcgcccgccggccaggagaacggagcttgtgatagatcctttcgtaacaccaagtattgtaccaggacctgcggctccgccccagaggccgccatcttcctgaccacccgaaaggccggacctactccccggtgcatcttgggatcagggcggggccctgagcgccgccatgcttttgtacggcaggatcgcaaagcacgccgggaccggttggtttggttttgaagacgtggatggcgggaattctcgcttctggcctggcaaggacattggagtccctatcaccggttgcctagacaacttcatgggaaggcccttgggaatctgagatggagcaggcgaaccctttacgtccagatggcgagtccaaaggaggtgttttagctcacttggaaaggctagagacccaagtgagcagatcccgtaaacagtctgaagagctgcagagcgtgcaggcccaggaaggtgctcttggaaccaagattcataaactaaggcgtctgcgagatgagctgagggctgtggtgcggcaccggcgagccagcgtgaaagcatgtattgccaatgtagaacccaaccaaacagtggagatcaatgagcaagaagcattggaagagaaattggaaaatgtgaaagccattctgcaggcatatcattttacaggcctcagtggtaaactgaccagccgaggagtttgtgtctgcatcagtactgcttttgaggggaacctattggattcctattttgtggaccttgtcatacagaaaccactccggatacatcaccattcagtcccagtcttcattcccctggaagagatagctgcaaaatatttacagaccaacatccagcacttcctgttcagtctctgcgagtacctgaatgcttactctgggaggaagtaccaggcagaccggcttcagagtgactttgcagccctcctgactgggcccttgcagagaaacccactgtgtaacttgctgtcatttacttacaaactggatccagggggtcagtccttcccgttctgtgctagattgctgtataaggacctcacagcaactcttcccactgacgtcaccgtgacatgtcaaggagtggaagtattatccacttcatgggaggagcaacgagcatctcatgaaactctgttctgtacgaagcccttgcatcaagtgtttgcctcatttacaagaaaaggagaaaagttggatatgagtctggtctcctaatagattgttttcactgcactgggagcacatcagagaaataaatcccccctcccctgccaggtgaaaggaaatattgcactttctgttctcatgactaaggggacaggagttccagaagaacctttcaagatgatcaggaacaccaggacgagggccgtctcacctcactcggaccacatggagacctcccttcaaaatgggagccatgtcctgccccaccaagccctgtctgaagtggagcttccccgcctgtgctccctccacagtcccggaaagcccagcggcaaaggcagctttgtcccagctctgccaccctcctgctcacagtggtcagggcccctcaggggcaaggacggcagggattggaacgagggctctggaaggactgttcagccctatgcctaagacccctatgctggggacactacaggcacacagaggaatagcagggccaccctcagagctcacacatccacgaacaaatgaaggctgaggaggtttctaaacctaaagtccatgagtgtgcacttcaatccaggaaggtcgggacttccttcagtttcaaaaaataaattctcccttccggtttggactgttgcaggctcgaggccattcaggagttgtccaccacctggtggggcagtgtgacagaggggccattggggaaggtggctagcttatcccgccccttcaagaagaaggtcagcagctcccccttccccttcacaaagatggggcctcgcctcacaaagcggaagccgtactctcggaggatgacttgggtttcttctaccacctggagagggagggggagcaagaacgtggcgttacggggggagcctagactgagggcgggtgggggctttgggtggttggagccgagcactgatccatgggtcccaagcagtacgggacactccccaaacctcccagggccaagcccttccacccgtggcgagcagcgggtgggaaggagaaccctggagtgactggctgggggcctcctctcatccagagacttctctcctaggatggccatggtcacctgggtggcagcactgttacctggaaactgccactgcctgctcttctgtccctttgcccctttcgtggagcttttctgccagacgccactgagacagatcacaaggtattagaaggttcatacccaaaggtaggccatatgcatctagaacttcagcccagattttgtggatgggtggaagtgtttcttcctgtgctgaggctagctattgcagagattcttttccacttgccccacgtctctgcctctggacttactgttcagggccagggtgggaggcaggggcacgtgggaaagcactgttccggttttgttctcatgccgagtctgagcacgtgccagctgtgccactggacatacctgaatgttgcccatgacccccgtggactccatcctgctggctacattgactgtattgccccagatgtcgtagtgtggtttccgggctccgatgaccccagccagaaccccgcctttgttcatgcctagggtagaggcataaagttcagcacagccacaggccacaccttgttatgggcctcagaagccatctcctctccagacctgtaccacaaagctcctaatgtaacacatcattgtcctcattcaacttggctgtatgctattggagggtggaaatcacatctcctgtttatccgtgtgcttgttaggtgtcagccgccaccccccccccatatgcagatttactcggcatggtagtggccagcttctaacacagctggtatttcaagtctcctgggacctcactcaggaatgataccccctcagtagaagcagcaggtgatcttaactcctttcaaagagcaggcctgtctgggaagccatgtcctcagcaggcacagcaacccctctggaaatggatcacaaactcacttctcagccaggcaggccaagcttctattgtaacagtaggcacagtatagtcggatcatcacatcagctgggtttttggtttagtcatctagagtcgtctggactaaaggtctttcaggtctccttgccctgtgagtgcgtgaacctccccacccgaattgcctcagttgtcctgagcctcatgtctctcctggtggtgggccaggcccctgcatgggaagggagcctgctgcggggcaggccagctgggggtgctcacctatgcgcagcatgaagttattgaaggactggttgttgatgttggtgagcgtatccttcatggccagcgcgaagtcggccaggtcagccaggtgctgccagcgctctctctcggacttgtcttcctgtgccaggggaccgtggagaaagtgtcaggggccgctcactgcagcagcctgctctgctgccttccctggcagtgttctgggggtggattccctacacctagatgttcaaggccttacttttcctcccacaaaggagtcgcagccacgctagctctgacttgccactgtgacaaagttcacgtagcaggtctaggcaaagactgggcaattgagcagaggagacggacctgtgagtctgaccacgaggcggaccccttcaccttggctgggcctggtcctggtccttaggttttgtcaggttgtccttgtttggatccctcaactaggtgataagcactggagggggatgacccgccttggacgtgtttctttaacctcatccatataatagggccgtgggatggttgtagaggtaaagcaggatgatggtgttttaagaccagagcttgggaccagggctcctacacctaattttctctcctggtagctgaacaaaggtctaaattagcttaacaaaagaacaggctgccgtcagccagagttctgaaggccatgctttcagtttcccttgttgacaattgctctccagttcctatgaaagcacagagccttagggggcctggccacagaacacaaccatcttaggcctgagctgtgaacagcagggggttgtgtgtctgttctgtttctctgcttgccgaactttctcaataaaccctatttcttatttataaaaaaatgg

SEQ ID NO: 288099 - DNA, 1506 bp, Homo sapiens
atgcgcccagctcttggaggtaagcggctgtgtgcgggtggtcgcggtgagtgtgcaaggccgcggtggccgcgtgacaagcctgcgctaccagtgcgcccgccggccaggagaacggagcttgtgatagatcctttcgtaacaccaagtattgtaccaggacctgcggctccgccccagaggccgccatcttcctgaccacccgaaaggccggacctactccccggtgcatcttgggatcagggcggggccctgagcgccgccatgcttttgtacggcaggatcgcaaagcacgccgggaccggttggtttggttttgaagacgtggatggcgggaattctcgcttctggcctgggtgttttagctcacttggaaaggctagagacccaagtgagcagatcccgtaaacagtctgaagagctgcagagcgtgcaggcccaggaaggtgctcttggaaccaagattcataaactaaggcgtctgcgagatgagctgagggctgtggtgcggcaccggcgagccagcgtgaaagcatgtattgccaatgtagaacccaaccaaacagtggagatcaatgagcaagaagcattggaagagaaattggaaaatgtgaaagccattctgcaggcatatcattttacaggcctcagtggtaaactgaccagccgaggagtttgtgtctgcatcagtactgcttttgaggggaacctattggattcctattttgtggaccttgtcatacagaaaccactccggatacatcaccattcagtcccagtcttcattcccctggaagagatagctgcaaaatatttacagaccaacatccagcacttcctgttcagtctctgcgagtacctgaatgcttactctgggaggaagtaccaggcagaccggcttcagagtgactttgcagccctcctgactgggcccttgcagagaaacccactgtgtaacttgctgtcatttacttacaaactggatccagggggtcagtccttcccgttctgtgctagattgctgtataaggacctcacagcaactcttcccactgacgtcaccgtgacatgtcaaggagtggaagtattatccacttcatgggaggagcaacgagcatctcatgaaactctgttctgtacgaagcccttgcatcaagtgtttgcctcatttacaagaaaaggagaaaagttggatatgagtctggtctcctaatagattgttttcactgcactgggagcacatcagaggtaagtaaccagtactgaagacagtaccaggtgggtagtactgtctgatgaagggtacatcacccttctgatgaaaacagacacctacctgttcatctggatggaagagcaggtttgagtatagacactggcatttttgaacaattcccatgatcacctggtcccttcttaaaatgctcaagatgttttttaaaggtattagttgatcatacattttagttgaaaatcatttgtggggcaataaaagccattttttga

SEQ ID NO: 288100 - DNA, 404 bp, Homo sapiens
aggtgtcttcttgtttgcctcaggcctcagtggtaaactgaccagccgaggagtttgtgtctgcatcagtactgcttttgaggggaacctattggattcctattttgtggaccttgtcatacagaaaccactccggatacatcaccattcagtcccagtcttcattcccctggaagagatagctgcaaaatatttacagaccaacatccagcacttcctgttcagtctctgcgagtacctgaatgcttactctgggaggaagtaccaggcagaccggcttcaggtatctctctgggatgttatatgcctcatccgtgggcccaagatcaacttaaaagggggatgttttttgtattttcagtgtttcctaactgtgagttagaagtttgaccgttacctttccg

SEQ ID NO: 288101 - DNA, 430 bp, Homo sapiens
ccaccattccttttgtgaggccttcagcaatggcaaagcagcagtaagttccagagcctttcattactgaagccactagtggaaatccagaaaattgtcagctgttcagttcttgttgctaatgagctaggtactctcaatctggttcctaatcaactgggcattcaaattttgaaaaatttccatgtttctagaagatgttgccagacctatcctgttaaaaactggtaggttctaagtgccagagatttttagctgacttctctgaccagcactaaactcagcaaatagtttccctaatcaaaaatttacacttttcccccaaaccctcaggatttggctgctctgcctgtgccaatgccatctcatttcttgatttcctcccttacctcatttccttcttccatttcaatccctgtgcctctcttaa

SEQ ID NO: 288102 - DNA, 926 bp, Homo sapiens
tctcggctcactgcaatctctgcctcccgggttcaagcaattcttctgcctcagccttgcaagtaactgggattacaggcatgcaccaccatgcctggctaattttctatatctttttagtagagatggagtttcaccatgttggtcaggctggtctcaaactcctgacctcaagtgatccgctcgccttggcctcccaaagtttgggactacaggcgccggccaccacgcccggctaattttttgtatttttagcagagacagggtttcactgtgttagccaggatggtctcaatcttctgacctcgtgatccgcctttctcggcctctgaaagtgctgcgattataggcgtgagccacggcgcccggcctttggcctcataattctttatttccttcctaggtctcttattacttttaatatttacccaacctttttgagtcatccataatgaatgtatagttcatttgatttgatttgatttatttttttgagatggagtctcgctctgtcacccagactggagttcagtggtgtgatcttgtcccactgcagcctccacctcctgggttctagtgattctcctgccttagcctcccaggtagctgggagtacaagcacgtgccaccacacttggctaatttttgtatttctagtagagacggagtttcaccatgttgaccaggctggtctcaaactcctgacttcaggggatctgcccgcctcggactcccaaagtgctaggattgcaggagtgagccactgcgtctggccatgaatgtatagttcaaatacctagtccactgaccttgccttttaaaacagttgtgtctgggctcagtggctcaggcctgtaatctcagcactttgggaggccaaagcaggaggattgcttgagtacaggagttcgagaccagcctgggca

SEQ ID NO: 288103 - DNA, 886 bp, Homo sapiens
ggtcccataaggcagcctcaccctcctcctcagagtcctctagcttcaccatgacaggcccctcatcttctgggggtgctcggtctggggagcccagcaccgcaggcctcatagagggtaccaggtcaggtatctgaggccagtgtctgcccctggtgaagaaataggatgaggctgttgcaaaaggagtacagtgaatgcttcactgcctagtctatgctgtaccgtttgatcctcagacctaccccatgtggaaggcagatgaggaaacaggcaaagaaaggccatctacaacccacagacttatgcagctggaagccctcccttagccacctgtatccctggtcttctctccgcttgggcctgtgcaaagtctctgacagtctccctgctccaaacacaggcttttttttcttttctttgagacatgctgtcagtcagttgcccaggctgaagtgcagtggcgagatcatgcgtcactgcagacttgacctcccgggctccagagatcggcctcccaagtagctgagacaacaggtgtgtgccacgacatccggctaatttcttaatttttctgtagggatgggatcttactatgttgcctaggctgttcttgaactcctgggctcaagcagatgatcctcttaccttgacctcccgaagtgctgggacttacaggtttgttccaccatgccagcccacaggctgttttttaggactagaagacacttctctcccctgtatccttcccttcttctacatgtgcaacctcattcctgcgctacagctctctctttaccaggtggatggcacctatacacctacagcctgggcatcagcatcactgctggcgtctccccctacccaacgccagcccttacttcac

SEQ ID NO: 288104 - DNA, 724 bp, Homo sapiens
tcacctccgctgctgccgccacccgcccggcctgcctttgaccctatgggtcacagacaaggcagggtgatcgcggcaagaccctgagtgagactagatgcgttacccagagggtgcgaggtcgagtaccttccctgtcccatcgcaaacccaaagatccccgttcctggagattctgattgaggtcccagccctacctgtcctgatgcctgaccagcaggatgcaagcccaggaggccatccaggataccaggactgggagagaatgcccagtggtgattcctgcatagtcctaggaggtgtcttgggcccaggctctggagttggaggctcagtttcagggatgggatcttactatgttgcctaggctgttcttgaactcctgggctcaagcagatgatcctcttaccttgacctcccgaagtgctgggacttacagctgcggctttaggaaggaatctgcgtttatgaaggggatggcaccgcagaatcattcccccgtgggtggcatcgatttcgagggccgcctcatcctgggggccaagcctccactcttcaaggtgccaagtcaacctgaaaccctgggagagacttgggtcatagccaagatggcaggtacctacggagggtcccgaaatacacttcccagaagtccaggcggcaacttccgctccagggtgccaagccctgggcgctcccgcaaggactgcccggattcgttccc

SEQ ID NO: 288105 - DNA, 425 bp, Homo sapiens
aaatagagtagaaagacaaaggaatggaaaattggagtgaaaagataagaacattaaaggacccatcccagatgccaatagccaagtaagaggcatcccagaaacagggagcagagcaatagaagggaaggaaataaaaaaaaatttcaaggcagtttcccagaactgagagatgtgaatttcaaactgaaaaagctcaccaacaatagtgataaaaaaaggtctgtgactgtactaataaaaagaattcttccagccaaacttcaatctaatgttgagggctagacaatgtgtttcagatatgggacatgtcagaattttatcttccacaccagaacacccacaaagctccaccaaaacaaaggtgtgaactaagaaagaggagaccctgggtctcaggaacaggaaggaacataacagaagat

SEQ ID NO: 288106 - DNA, 442 bp, Homo sapiens
caggaaggaacataacagaagatgggttgtaggaggagcctggatgatgccagacaaaggtggtggctgagaggtagatggcagggggcctctggtccgtaatgcttcgatgattgggcaggatccctatcctgtgtcaaggtccctcctgcccacctgctctgtctactaacctgctgtccttgtcaggtcccagccctacctgtcctgatgcctgaccagcaggatgcaagcccaggaggccatccaggataccaggactgggagagaatgtgggtacggggaatactcgccctgcttgcaaaaggttttactagggtggggagtttctagaaagtagaggggctgtgggatcagtggtagtggtgggtggctttttttgagggcagaagatgctagaggaggttgaaccttataggggatgatctagggaatgggggaa

SEQ ID NO: 288107 - DNA, 504 bp, Homo sapiens
atgatttctacaggtaacttagaaatatatttgagtcctgaaaagaggaagactgatttcctttttaaattagcaatgcctagcatttttggctatttgccggtgttgagactataactaactgaaaattttatcatcaatctacttgaagatcgtgtttaagactgtaactgtgggtaggcgtggtggcttatgcctgtaatcctagcactttgggaggctgaagtgggaggatcactggagcccaggagttctaaaccagcctgggcaacatagggagaccctgtctctacaaaacaaaacaaagaccataactatggaaaaacctaatgctacagtaactgatgtcattcatgtaactcatgttgtgtaatgttttcctagaaatttcaaggtaaagatgtcggggttaagtgtttgatatatcccagtcactgtgacagttttgactcttcacgcctccaaaaattgttttcagcccagaaacatttgagaggcttttaa

SEQ ID NO: 288108 - DNA, 1440 bp, Homo sapiens
ccaggcggaagtgcgtaccggaagtgccagcggcagtgtgtaagacgctcacgggcgcgcggactatcgggcggctaggctctctgaggaggctgccacagtgaagcagccgtgacaagtggtgcccgaccagggacctgaacgaggaaggtctgccagagcagagaaagtgaaactgatcagacgaactacgaacccctggacgggagagtctgccggcggagaatataaggagatggacaaaccgtgtgggtgccctccaggtgtgtgtgaccatggaacgggagaccggagggatccatggtattcaaccgtgggcctgttacctccagtacgagccatgagccagcggaatctgaatgcaaagacagaacaagggccgaccggagtcacaatgacatccaaccccataacatggggacagatcaagaaaacgacacaagaagctgagaaactactggagcgccagggtcaggcaaaaacccctgactccatgttcttggccatgctagctgtagtgtcctgtgcgtctataggatcgggtgaaccaccaaccggcaattgaaagctgcacagcctgaaattacctttattcaattaatgcaaaaacaaaaggggagatgttggaggccgaaggaatgagggtcgtgaccaactcagtataccactggaggctctgtgagcaaacagcaaactgttctcatgaaagcaggatgttggcgaactgacaaactctgtctgccgccagaaggaatgctgggggcagtcatgtcccaggtcccgtgctccttgaggttatccacaggaacatccagaacctgttgaacaaagaaaggaatcatgtgggcctgtgttaaatcaaatagctgaccgacagttatcccttcctccctattcactctacctaataaatatgaagggctgtaaaagctcaggtccctgttccctaatatcaaggagccccctgaccccttctttcaaacagatccttttgtctgtctcatttctgcattcgtcgtccttcgttcggtccagaagcaaccgcgacagtcctgcatgtgttgatgccacctgtatgtgcaggtgtgacctcaggtgtgtgagtatccctcataccccttatcatcactgcctattcgctcttcctccagcctctggcaaccactaatccacgttatatgtctagatttgcctcttctggacacttcatataaatggagtcatacaatatgtggtttcttgtgtctggctttttaccactgaacgttttcagagttcatccatgttgtagcatgtatcagtttttcattcctctttatggctgaataatactgcattgtatggatataccacagtttgtttactcattagttcatagacattggggttgtttccaactctctgatattataaatgctactgctgtgaaaattcaaaaca

SEQ ID NO: 288109 - DNA, 1391 bp, Homo sapiens
ccaggcggaagtgcgtaccggaagtgccagcggcagtgtgtaagacgctcacgggcgcgcggactatcgggcggctaggctctctgaggaggctgccacagtgaagcagccgtgacaagtggtgcccgaccagggacctgaacgaggaaggtctgccagagcagagaaagtgaaactgatcagacgaactacgaacccctggacgggagagtctgccggcggagaatataaggagatggacaaaccgtgtgggtgccctccaggtgtgtgtgaccatggaacgggagaccggagggatccatggtattcaaccgtgggcctgttacctccagtacgagccatgagccagcggaatctgaatgcaaagacagaacaagggccgaccggagtcacaatgacatccaaccccataacatggggacagatcaagaaaacgacacaagaagctgagaaactactggagcgccagggtcaggcaaaaacccctgactccatgttcttggccatgctagctgtagtgtcctgtgcgtctataggatcgggtgaaccaccaaccggcaattgaaagctgcacagcctgaaattacctttattcaattaatgcaaaaacaaaaggggagatgttggaggccgaaggaatgagggtcgtgaccaactcagtataccactggaggctctgtgagcaaacagcaaactgttctcatgaaagcaggatgttggcgaactgacaaactctgtctgccgccagaaggaatgctgggggcagtcatgtcccaggtcccgtgctccttgaggttatccacaggaacatccagaacctgttgaacaaagaaaggaatcatgtgggcctgtgttaaatcaaatagctgaccgacagttatcccttcctccctattcactctacctaataaatatgaagggctgtaaatcaaacagatccttttgtctgtctcatttctgcattcgtcgtccttcgttcggtccagaagcaaccgcgacagtcctgcatgtgttgatgccacctgtatgtgcaggtgtgacctcaggtgtgtgagtatccctcataccccttatcatcactgcctattcgctcttcctccagcctctggcaaccactaatccacgttatatgtctagatttgcctcttctggacacttcatataaatggagtcatacaatatgtggtttcttgtgtctggctttttaccactgaacgttttcagagttcatccatgttgtagcatgtatcagtttttcattcctctttatggctgaataatactgcattgtatggatataccacagtttgtttactcattagttcatagacattggggttgtttccaactctctgatattataaatgctactgctgtgaaaattcaaaaca

SEQ ID NO: 288110 - DNA, 1409 bp, Homo sapiens
ccaggcggaagtgcgtaccggaagtgccagcggcagtgtgtaagacgctcacgggcgcgcggactatcgggcggctaggctctctgaggaggctgccacagtgaagcagccgtgacaagtggtgcccgaccagggacctgaacgaggaaggtctgccagagcagagaaagtgaaactgatcagacgaactacgaacccctggacgggagagtctgccggcggagaatataaggtgtgtgtgaccatggaacgggagaccggagggatccatggtattcaaccgtgggcctgttacctccagtacgagccatgagccagcggaatctgaatgcaaagacagaacaagggccgaccggagtcacaatgacatccaaccccataacatggggacagatcaagaaaacgacacaagaagctgagaaactactggagcgccagggtcaggcaaaaacccctgactccatgttcttggccatgctagctgtagtgtcctgtgcgtctataggatcgggtgaaccaccaaccggcaattgaaagctgcacagcctgaaattacctttattcaattaatgcaaaaacaaaaggggagatgttggaggccgaaggaatgagggtcgtgaccaactcagtataccactggaggctctgtgagcaaacagcaaactgttctcatgaaagcaggatgttggcgaactgacaaactctgtctgccgccagaaggaatgctgggggcagtcatgtcccaggtcccgtgctccttgaggttatccacaggaacatccagaacctgttgaacaaagaaaggaatcatgtgggcctgtgttaaatcaaatagctgaccgacagttatcccttcctccctattcactctacctaataaatatgaagggctgtaaaagctcaggtccctgttccctaatatcaaggagccccctgaccccttctttcaaacagatccttttgtctgtctcatttctgcattcgtcgtccttcgttcggtccagaagcaaccgcgacagtcctgcatgtgttgatgccacctgtatgtgcaggtgtgacctcaggtgtgtgagtatccctcataccccttatcatcactgcctattcgctcttcctccagcctctggcaaccactaatccacgttatatgtctagatttgcctcttctggacacttcatataaatggagtcatacaatatgtggtttcttgtgtctggctttttaccactgaacgttttcagagttcatccatgttgtagcatgtatcagtttttcattcctctttatggctgaataatactgcattgtatggatataccacagtttgtttactcattagttcatagacattggggttgtttccaactctctgatattataaatgctactgctgtgaaaattcaaaaca

SEQ ID NO: 288111 - DNA, 1381 bp, Homo sapiens
ccaggcggaagtgcgtaccggaagtgccagcggcagtgtgtaagacgctcacgggcgcgcggactatcgggcggctaggctctctgaggaggctgccacagtgaagcagccgtgacaagtggtgcccgaccagggacctgaacgaggaaggtctgccagagcagagaaagtgaaactgatcagacgaactacgaacccctggacgggagagtctgccggcggagaatataaggagatggacaaaccgtgtgggtgccctccaggtgtgtgtgaccatggaacgggagaccggagggatccatggtattcaaccgtgggcctgttacctccagtacgagccatgagccagcggaatctgaatgcaaagacagaacaagggccgaccggagtcacaatgacatccaaccccataacatggggacagatcaagaaaacgacacaagaagctgagaaactactggagcgccaggtctataggatcgggtgaaccaccaaccggcaattgaaagctgcacagcctgaaattacctttattcaattaatgcaaaaacaaaaggggagatgttggaggccgaaggaatgagggtcgtgaccaactcagtataccactggaggctctgtgagcaaacagcaaactgttctcatgaaagcaggatgttggcgaactgacaaactctgtctgccgccagaaggaatgctgggggcagtcatgtcccaggtcccgtgctccttgaggttatccacaggaacatccagaacctgttgaacaaagaaaggaatcatgtgggcctgtgttaaatcaaatagctgaccgacagttatcccttcctccctattcactctacctaataaatatgaagggctgtaaaagctcaggtccctgttccctaatatcaaggagccccctgaccccttctttcaaacagatccttttgtctgtctcatttctgcattcgtcgtccttcgttcggtccagaagcaaccgcgacagtcctgcatgtgttgatgccacctgtatgtgcaggtgtgacctcaggtgtgtgagtatccctcataccccttatcatcactgcctattcgctcttcctccagcctctggcaaccactaatccacgttatatgtctagatttgcctcttctggacacttcatataaatggagtcatacaatatgtggtttcttgtgtctggctttttaccactgaacgttttcagagttcatccatgttgtagcatgtatcagtttttcattcctctttatggctgaataatactgcattgtatggatataccacagtttgtttactcattagttcatagacattggggttgtttccaactctctgatattataaatgctactgctgtgaaaattcaaaaca

SEQ ID NO: 288112 - DNA, 1143 bp, Homo sapiens
ccaggcggaagtgcgtaccggaagtgccagcggcagtgtgtaagacgctcacgggcgcgcggactatcgggcggctaggctctctgaggaggctgccacagtgaagcagccgtgacaagtggtgcccgaccagggacctgaacgaggaaggtctgccagagcagagaaagtgaaactgatcagacgaactacgaacccctggacgggagagtctgccggcggagaatataagtctataggatcgggtgaaccaccaaccggcaattgaaagctgcacagcctgaaattacctttattcaattaatgcaaaaacaaaaggggagatgttggaggccgaaggaatgagggtcgtgaccaactcagtataccactggaggctctgtgagcaaacagcaaactgttctcatgaaagcaggatgttggcgaactgacaaactctgtctgccgccagaaggaatgctgggggcagtcatgtcccaggtcccgtgctccttgaggttatccacaggaacatccagaacctgttgaacaaagaaaggaatcatgtgggcctgtgttaaatcaaatagctgaccgacagttatcccttcctccctattcactctacctaataaatatgaagggctgtaaaagctcaggtccctgttccctaatatcaaggagccccctgaccccttctttcaaacagatccttttgtctgtctcatttctgcattcgtcgtccttcgttcggtccagaagcaaccgcgacagtcctgcatgtgttgatgccacctgtatgtgcaggtgtgacctcaggtgtgtgagtatccctcataccccttatcatcactgcctattcgctcttcctccagcctctggcaaccactaatccacgttatatgtctagatttgcctcttctggacacttcatataaatggagtcatacaatatgtggtttcttgtgtctggctttttaccactgaacgttttcagagttcatccatgttgtagcatgtatcagtttttcattcctctttatggctgaataatactgcattgtatggatataccacagtttgtttactcattagttcatagacattggggttgtttccaactctctgatattataaatgctactgctgtgaaaattcaaaaca

SEQ ID NO: 288113 - DNA, 437 bp, Homo sapiens
  misc_feature (283)..(283): n is a, c, g, or t
  misc_feature (293)..(293): n is a, c, g, or t
  misc_feature (302)..(302): n is a, c, g, or t
  misc_feature (431)..(431): n is a, c, g, or t
ccaggcggaagtgcgtaccggaagtgccagcggcagtgtgtaagacgctcacgggcgcgcggactatcgggcggctaggctctctgaggaggctgccacagtgaagcagccgtgacaagtggtgcccgaccagggacctgaacgaggaaggtctgccagagcagagaaagtgaaactgatcagacgaactacgaacccctggacgggagagtctgccggcggagaatataaggagatggacaaaccgtgtgggtgccctccaggtgtgtgtgaccatggaaangcgcagaaangcaggcgcntaaatgcgctattaaaaagctgcgcgcaatgcttaaataaagctaagcagcaaatcgcagcaaagcagcgcaatatcgcaatgcaaaagcaaagcaaaaagcgcgcaagcaaagtcgtcagctaaaaantgcaaa

SEQ ID NO: 288114 - DNA, 593 bp, Homo sapiens
aagacacaagacaaagagataaaaggcagctgggcctgggggaccactaccaccaatgcgcggagaccggtagtggccccgaatgtctggctgcgctcttatttattggatacaaagcaaaaggggcagggtaaagagtgtgagtcatctccaatgataggtaaggtcacgtgggtcatgtgtccactggtcagggggcccttccctgcatgtgttgatgccacctgtatgtgcaggtgtgacctcaggtgtgtgagtatccctcataccccttatcatcactgcctattcgctcttcctccagcctctggcaaccactaatccacgttatatgtctagatttgcctcttctggacacttcatataaatggagtcatacaatatgtggtttcttgtgtctggctttttaccactgaacgttttcagagttcatccatgttgtagcatgtatcagtttttcattcctctttatggctgaataatactgcattgtatggatataccacagtttgtttactcattagttcatagacattggggttgtttccaactctctgatattataaatgctactgctgtgaaaattcaaaaca

SEQ ID NO: 288115 - DNA, 572 bp, Homo sapiens
gtgacttatggagggagtgctcctaggagaaacctggcatagtgaagcaaggatatagtttccaggaagcccagccacaaccagatcttgagggaggtctggaacataaatttcaggtctttcctgcctgaaggtgaaggagcagggcgttagaaccccacctaccaggcagtcattggaaccaaggcttgccgggttggagctgtaactcccacacccttccaggcaaggcactctgagaaaaggatccaccaagatctgggtggggtaccaacagcgtcttgcatagtgccttgcccaccccaaagaaatgtcacttgcctgatgacatatcacagtgattctcatgaaattagatcccttccttagatccatgtgatgcttatggtccgtgcattccatttgcaaatctgtgaagactaataaggctcacactaatcaataccagttaagggtgtggggttgtacagcacagaagtggatgggtttaggctcttgatctacaaatctctgggatgtgaagtgagttgacctttctgtcatcttgataacccattagccccagagcactt

SEQ ID NO: 288116 - DNA, 132 bp, Homo sapiens
ggggatgttctgagcaagaacatccggaccgatgacattacaagcggatacatgactgatggtggacttggcctctatacccgtcgcctgaaccggctccctgatgggatggctgtggtacgggagaccctg

SEQ ID NO: 288117 - DNA, 571 bp, Homo sapiens
  misc_feature (13)..(13): n is a, c, g, or t
  misc_feature (17)..(18): n is a, c, g, or t
  misc_feature (69)..(69): n is a, c, g, or t
  misc_feature (99)..(99): n is a, c, g, or t
  misc_feature (102)..(102): n is a, c, g, or t
gggggggaggggngggnngggcgcaggagggcggagggggagtacaggggggagggatttagaaagaantctacatttctgaaggaacccactcaacanaanaagactcaataagcagataaatgacaaagagcgagtggcagctgcaatggaaaaccccaacttacgggaaattgtggaacagtgtgtccttgaacctgactgatagctgttttaagagccactggcctgtaattgtttgatatatttgtttaaactctttgtataatgtcagagactcatgtttaatacataggtgatttgtacctcagagcattttttaaaggattctttccaagcgagatttaattataaggtagtacctaatttgttcaatgtataacattctcaggatttgtaacacttaaatgatcagacagaataatattttctagttattatgtgtaagatgagttgctatttttctgatgctcattctgatacaactatttttcgtgtcaaatatctactgtgcccaaatgtactcaatttaaatcattactctgtaaaataaataagcagatgattctta

SEQ ID NO: 288118 - DNA, 1713 bp, Homo sapiens
  misc_feature (22)..(22): n is a, c, g, or t
  misc_feature (24)..(24): n is a, c, g, or t
aagcgtggtatcaacgcagagngnccattatggccggggaatgtgctgacgagccgcgaagattgtttttgtcccgccgaaatcgagcaaagcacgctggaacttgtagtccttgaggccccttccctaggtccttcgagctactccgtctggccccgccttttctctgctctcctgaacctttaggcttgtctcggcccatttgaagaccaggaagttgatcaatcccgaggctgctgagagacggtggcgcgattgggacagtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaggtttatgatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgggctgtgcttaagagtaaaacttcagcgatgtttaccatttaaacataagttggaaatctacatttctgaaggaacccactcaacagaagaagacatcaataagcagataaatgacaaagagcgagtggcagctgcaatggaaaaccccaacttacgggaaattgtggaacagtgtgtccttgaacctgactgatagctgttttaagagccactggcctgtaattgtttgatatatttgtttaaactctttgtataatgtcagagactcatgtttaatacataggtgatttgtacctcagagcattttttaaaggattctttccaagcgagatttaattataaggtagtacctaatttgttcaatgtataacattctcaggatttgtaacacttaaatgatcagacagaataatattttctagttattatgtgtaagatgagttgctatttttctgatgctcattctgatacaactatttttcgtgtcaaatatctactgtgcccaaatgtactcaatttaaatcattactctgtaaaataaataagcagatgattcttaaaaaaaaaaaaaaaaaaaaaaaaaaaaaaaaaaaaaaaaaaaaaaaaaaaaaaaaaaaaaaaaaaaaaaaaaaaaaaaaaaacctttctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgtttt

SEQ ID NO: 288119 - DNA, 913 bp, Homo sapiens
  misc_feature (22)..(22): n is a, c, g, or t
  misc_feature (24)..(24): n is a, c, g, or t
aagcgtggtatcaacgcagagngnccattatggccggggtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaggtttatgatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgggctgtgcttaagagtaaaacttcagcgatgtttaccatttaaacataagttggaaatctacatttctgaaggaacccactcaacagaagaagacatcaataagcagataaatgacaaagagcgagtggcagctgcaatggaaaaccccaacttacgggaaattgtggaacagtgtgtccttgaacctgactgatagctgttttaagagccactggcctgtaattgtttgatatatttgtttaaactctttgtataatgtcagagactcatgtttaatacataggtgatttgtacctcagagcattttttaaaggattctttccaagcgagatttaattataaggtagtacctaatttgttcaatgtataacattctcaggatttgtaacacttaaatgatcagacagaataatattttctagttattatgtgtaagatgagttgctatttttctgatgctcattctgatacaactatttttcgtgtcaaatatctactgtgcccaaatgtactcaatttaaatcattactctgtaaaataaataagcagatgattctta

SEQ ID NO: 288120 - DNA, 1088 bp, Homo sapiens
  misc_feature (22)..(22): n is a, c, g, or t
  misc_feature (24)..(24): n is a, c, g, or t
aagcgtggtatcaacgcagagngnccattatggccggggaatgtgctgacgagccgcgaagattgtttttgtcccgccgaaatcgagcaaagcacgctggaacttgtagtccttgaggccccttccctaggtccttcgagctactccgtctggccccgccttttctctgctctcctgaacctttaggcttgtctcggcccatttgaagaccaggaagttgatcaatcccgaggctgctgagagacggtggcgcgattgggacagtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaggtttatgatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgttggaaatctacatttctgaaggaacccactcaacagaagaagacatcaataagcagataaatgacaaagagcgagtggcagctgcaatggaaaaccccaacttacgggaaattgtggaacagtgtgtccttgaacctgactgatagctgttttaagagccactggcctgtaattgtttgatatatttgtttaaactctttgtataatgtcagagactcatgtttaatacataggtgatttgtacctcagagcattttttaaaggattctttccaagcgagatttaattataaggtagtacctaatttgttcaatgtataacattctcaggatttgtaacacttaaatgatcagacagaataatattttctagttattatgtgtaagatgagttgctatttttctgatgctcattctgatacaactatttttcgtgtcaaatatctactgtgcccaaatgtactcaatttaaatcattactctgtaaaataaataagcagatgattctta

SEQ ID NO: 288121 - DNA, 1058 bp, Homo sapiens
  misc_feature (22)..(22): n is a, c, g, or t
  misc_feature (24)..(24): n is a, c, g, or t
aagcgtggtatcaacgcagagngnccattatggccggggaatgtgctgacgagccgcgaagattgtttttgtcccgccgaaatcgagcaaagcacgctggaacttgtagtccttgaggccccttccctaggtccttcgagctactccgtctggccccgccttttctctgctctcctgaacctttaggcttgtctcggcccatttgaagaccaggaagttgatcaatcccgaggctgctgagagacggtggcgcgattgggacagtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaggtttatgatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgggctgtgcttaagagtaaaacttcagcgatgtttaccatttaaacataagttggaaatctacatttctgaaggaacccactcaacagaagaagacatcaataagcagataaatgacaaagagcgagtggcagctgcaatggaaaaccccaacttacgggaaattgtggaacagtgtgtccttgaacctgactgatagctgttttaagagccactggcctgtaattgtttgatatatttgtttaaactctttgtataatgtcagagactcatgtttaatacataggtgatttgtacctcagagcattttttaaaggattctttcaggagattatataggtgtactaattgtcagttacatctcgattgtaccttaggtcgacgatatattcacgttaggtgaaggagggcaattcgaggcctcggtaacatttggggaattagggccgtgtcctaaatatcgttgaaaaggggttttaaac

SEQ ID NO: 288122 - DNA, 714 bp, Homo sapiens
  misc_feature (22)..(22): n is a, c, g, or t
  misc_feature (24)..(24): n is a, c, g, or t
  misc_feature (691)..(691): n is a, c, g, or t
  misc_feature (702)..(702): n is a, c, g, or t
aagcgtggtatcaacgcagagngnccattatggccggggaatgtgctgacgagccgcgaagattgtttttgtcccgccgaaatcgagcaaagcacgctggaacttgtagtccttgaggccccttccctaggtccttcgagctactccgtctggccccgccttttctctgctctcctgaacctttaggcttgtctcggcccatttgaagaccaggaagttgatcaatcccgaggctgctgagagacggtggcgcgattgggacagtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaggtttatgatttgattagaactatccgggacccagaaaagcccaatactttagaagaactggaagtggtctcggaaagttgtgtggaagttcaggagataaatgaagaaaatttttggggaattaacaagggttaccgcaaacaaccccccttttgtttttttgggggaattttttattgggctttttgtttttaaaaattctttttttgcgggggggcccccctttttttttcatcacatcccctcttttttggccctggaacccccccccccccggtgtggggntttttttctcnataatccacccg

SEQ ID NO: 288123 - DNA, 629 bp, Homo sapiens
cttaagtctgccttctagatgggaaattacattatgagtaattagccaaaaacaggtttaagttctcaaggagttaaagtttttgtttcagcaggctaataaaaatactgtctggtgctgtatattgacacagttcttctgctaacttttgtctgtgtatttttcagtcaataagcagataaatgacaaagagcgagtggcagctgcaatggaaaaccccaacttacgggaaattgtggaacagtgtgtccttgaacctgactgatagctgttttaagagccactggcctgtaattgtttgatatatttgtttaaactctttgtataatgtcagagactcatgtttaatacataggtgatttgtacctcagagcattttttaaaggattctttccaagcgagatttaattataaggtagtacctaatttgttcaatgtataacattctcaggatttgtaacacttaaatgatcagacagaataatattttctagttattatgtgtaagatgagttgctatttttctgatgctcattctgatacaactatttttcgtgtcaaatatctactgtgcccaaatgtactcaatttaaatcattactctgtaaaataaataagcagatgattct

SEQ ID NO: 288124 - DNA, 1138 bp, Homo sapiens
  misc_feature (22)..(22): n is a, c, g, or t
  misc_feature (24)..(24): n is a, c, g, or t
aagcgtggtatcaacgcagagngnccattatggccggggaatgtgctgacgagccgcgaagattgtttttgtcccgccgaaatcgagcaaagcacgctggaacttgtagtccttgaggccccttccctaggtccttcgagctactccgtctggccccgccttttctctgctctcctgaacctttaggcttgtctcggcccatttgaagaccaggaagttgatcaatcccgaggctgctgagagacggtggcgcgattgggacagtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaggtttatgatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgggctgtgcttaagagtaaaacttcagcgatgtttaccatttaaacataagttggaaatctacatttctgaaggaacccactcaacagaagaagacatcaataagcagataaatgacaaagagcgagtggcagctgcaatggaaaaccccaacttacgggaaattgtggaacagtgtgtccttgaacctgactgatagctgttttaagagccactggcctgtaattgtttgatatatttgtttaaactctttgtataatgtcagagactcatgtttaatacataggtgatttgtacctcagagcattttttaaaggattctttccaagcgagatttaattataaggtagtacctaatttgttcaatgtataacattctcaggatttgtaacacttaaatgatcagacagaataatattttctagttattatgtgtaagatgagttgctatttttctgatgctcattctgatacaactatttttcgtgtcaaatatctactgtgcccaaatgtactcaatttaaatcattactctgtaaaataaataagcagatgattctta

SEQ ID NO: 288125 - DNA, 1307 bp, Homo sapiens
  misc_feature (22)..(22): n is a, c, g, or t
  misc_feature (24)..(24): n is a, c, g, or t
aagcgtggtatcaacgcagagngnccattatggccggggaatgtgctgacgagccgcgaagattgtttttgtcccgccgaaatcgagcaaagcacgctggaacttgtagtccttgaggccccttccctaggtccttcgagctactccgtctggccccgccttttctctgctctcctgaacctttaggcttgtctcggcccatttgaagaccaggaagttgatcaatcccgaggctgctgagagacggtggcgcgattgggacagtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaggtttatgatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgggctgtgcttaagagtaaaacttcagcgatgtttaccatttaaacataagttggaaatctacatttctgaaggaacccactcaacagaagaagacatcaataagcagataaatgacaaagagcgagtggcagctgcaatggaaaaccccaacttacgggaaattgtggaacagtgtgtccttgaacctgactgatagctgttttaagagccactggcctgtaattgtttgatatatttgtttaaactctttgtataatgtcagagactcatgtttaatacataggtgatttgtacctcagagcattttttaaaggattctttccaagcgagatttaattataaggtagtacctaatttgttcaatgtataacattctcaggatttgtaacacttaaatgatcagacagaataatattttctagttattatgtgtaagatgagttgctatttttctgatgctcattctgatacaactatttttcgtgtcaaatatctactgtgcccaaatgtactcaatttaaatcattactctgcaacctaataggaaaatagaacattttccatgtgcatatattagttcttcttgcatgaatttcctgttcatgtctctattaatctactagattttttttaaaattagtttgaatggatcttcatataataaaggtattggcccattatgttttctgtaattagctaacaacattcttaatagaagagttcacaag

SEQ ID NO: 288126 - DNA, 1060 bp, Homo sapiens
  misc_feature (22)..(22): n is a, c, g, or t
  misc_feature (24)..(24): n is a, c, g, or t
aagcgtggtatcaacgcagagngnccattatggccggggaatgtgctgacgagccgcgaagattgtttttgtcccgccgaaatcgagcaaagcacgctggaacttgtagtccttgaggccccttccctaggtccttcgagctactccgtctggccccgccttttctctgctctcctgaacctttaggcttgtctcggcccatttgaagaccaggaagttgatcaatcccgaggctgctgagagacggtggcgcgattgggacagtcgccagggatggctgagcgtgaagatgcagcggccccggatcatggaagagaaagcgctagaggtttatgatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgggctgtgcttaagagtaaaacttcagcgatgtttaccatttaaacataagttggaaatctacatttctgaaggaacccactcaacagaagaagacatcaataagcagataaatgacaaagagcgagtggcagctgcaatggaaaaccccaacttacgggaaattgtggaacagtgtgtccttgaacctgactgatagctgttttaagagccactggcctgtaattgtttgatatatttgtttaaactctttgtataatgtcagagactcatgtttaatacataggtgatttgtacctcagagcattttttaaaggattctttccaagcgagatttaattataaggtagtacctaatttgttcaatgtataacattctcaggatttgtaacacttaaatgatcagacagaataatattttctagttattatgtgtaagatgagttgctatttttctgatgctcattctgatacaactatttttcgtgtcaaatatctactgtgcccaaatgtactcaatttaaatcattactctgtaaaataaataagcagatgattctta

SEQ ID NO: 288127 - DNA, 1168 bp, Homo sapiens
  misc_feature (22)..(22): n is a, c, g, or t
  misc_feature (24)..(24): n is a, c, g, or t
  misc_feature (1091)..(1091): n is a, c, g, or t
  misc_feature (1093)..(1093): n is a, c, g, or t
aagcgtggtatcaacgcagagngnccattatggccggggaatgtgctgacgagccgcgaagattgtttttgtcccgccgaaatcgagcaaagcacgctggaacttgtagtccttgaggccccttccctaggtccttcgagctactccgtctggccccgccttttctctgctctcctgaacctttaggcttgtctcggcccatttgaagaccaggaagttgatcaatcccgaggctgctgagagacggtggcgcgattgggacagtcgccagggatggctgagcgtgaagatgcagcgggtgtccgggctgctctcctggacgctgagcagagtcctgtggctctccggcctctctgagccgggagctgcccggcagccccggatcatggaagagaaagcgctagaggtttatgatttgattagaactatccgggacccagaaaagcccaatactttagaagaactggaagtggtctcggaaagttgtgtggaagttcaggagataaatgaagaagaatatctggttattatcaggttcacgccaacagtacctcattgctctttggcgactcttattgttggaaatctacatttctgaaggaacccactcaacagaagaagacatcaataagcagataaatgacaaagagcgagtggcagctgcaatggaaaaccccaacttacgggaaattgtggaacagtgtgtccttgaacctgactgatagctgttttaagagccactggcctgtaattgtttgatatatttgtttaaactctttgtataatgtcagagactcatgtttaatacataggtgatttgtacctcagagcattttttaaaggattctttccaagcgagatttaattataaggtagtacctaatttgttcaatgtataacattctcaggatttgtaacacttaaatgatcagacagaataatattttctagttattatgtgtaagatgagttgctatttttctgatgctcattctgatacaactatttttcgtgtcaaatatctactgtgcccaaatgtactcaatttaaatcattactctgtaaaataaataagcagatgattcttatananaacaaagatgcagacaaaaacgaaaaaaaaaagagggcggcgccaaaaaaccccagggggccaagatacgtcacc

SEQ ID NO: 288128 - DNA, 593 bp, Homo sapiens
ctcatagctgcttgcttacacactcacaccccagctgcacctggctcccaaacactcctcgcctgcccacgtttcctcacacacactcacacccgaatcatacagaggtgtgctctcaaatgcacacacacatacattcactcagcaaataggtgcagactccccaaaacaaacccagtctctgagccccctccaccaccctcccctctcccgacctcactcccaagggccttgcctcagtggaacactgtgatttggacagggaatgcatcctgacttctgcacaccggtatatcacctttcctgcatccttaattaaacaaatcctgagcatttacaattcaaccagtatgcattcagcacctactgtgagccaggcccagttctaggagctgggagagaagggcggtgacaaaagagaccaaaaatctctcacagagatgataatgtgtcccacatcgccgggcacagtggctcatgcctgtaatccaagcactttgggaggccgaggcgggtggatcacttgaggtcaagagttcgatgccactgcactccagcctagacaacagagcaagactctgtctcaaaaaaaa

SEQ ID NO: 288129 - DNA, 443 bp, Homo sapiens
gggatatcttccaggccggaccctccagagacaggtccacatcaatctggttatccttggttgctctgcccagggtgatctggggaaatggggcaggtacctcacggaagccggctttggccctgcggctgctaccgtcgccgcggagaaattgttggatctggcagtctaggaatgaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccttgggcaccatccctaaacggagaagctcctccaggtagtaa

SEQ ID NO: 288130 - DNA, 827 bp, Homo sapiens
cagaaggtaaaccatctctaagcacaacagcacgggaggcgccttgctgtgggcacggctgggtcactcaccggtcagatgcatggtctccaggagcttggacaccagcgccccgtcttcctccagctccacctgcacgaggcccagcttcctgcgcatcttctgcaggccaccgacgctcctgggaggcagtcagtgccgtctccctgcgtcactggcagaagactgaggctcagaggggcagagtgacctgccttgaccacccacgcatgtctatgccggagcaccaggctgccccagcggctcctcccggccttctgcagccccatcgcccacccacatggaacatggctggggtggactgcagggatggagctggggcaggacacagccctaggagcacctgcctggcgccagcttctgctgacggcagcccaacagcccccagccacgtggcaaagcgggtccccacgcagccctggctgcagctgctccaggggtggcctgagacttctcaaagaagatgctgtgcccggtcccccggaacccctacttggcctgaccccgctgatgctgcaggcccccagcccagccaggtgaggtgccgggttcccccaccgtgtgctgaatgccctgtgacaaggacgatgccatcaagccatgtgggacgtctgtggtgtccgtggggcggggacccagaccccaggtgggcactcagcatctccccagtcaggacccggctggctgccctgggcatcaagacgtatcgacccacgtgggaggtgcccagcccatggtccttccacccaagccagctcccaccccgc

SEQ ID NO: 288131 - DNA, 778 bp, Homo sapiens
gtaaccttgagaataggggccaatcaacaggggggccaggagcccccaaggtgcagggtgcactgagggccccaccggccctgctgaacacaggcctgacaccacctctctccttcaaggccaccgacgctcctgggaggcagtcagtgccgtctccctgcgtcactggcagaagactgaggctcagaggggcagagtgacctgccttgaccacccacgcatgtctatgccggagcaccaggctgccccagcggctcctcccggccttctgcagccccatcgcccacccacatggaacatggctggggtggactgcagggatggagctggggcaggacacagccctaggagcacctgcctggcgccagcttctgctgacggcagcccaacagcccccagccacgtggcaaagcgggtccccacgcagccctggctgcagctgctccaggggtggcctgagacttctcaaagaagatgctgtgcccggtcccccggaacccctacttggcctgaccccgctgatgctgcaggcccccagcccagccaggtgaggtgccgggttcccccaccgtgtgctgaatgccctgtgacaaggacgatgccatcaagccatgtgggacgtctgtggtgtccgtggggcggggacccagaccccaggtgggcactcagcatctccccagtcaggacccggctggctgccctgggcatcaagacgtatcgacccacgtgggaggtgcccagcccatggtccttccacccaagccagctcccaccccgc

SEQ ID NO: 288132 - DNA, 317 bp, Homo sapiens
aagtgcactccccgtcttctctgggtgatgaagacaaagaaactctggaccacccgctgcctcaacaacctcagagattctgactctaaagagcccccctcctgtaagtcctccagcggccacagccggttacgagcacccacaggcggctgtcaccaaaagatctcatcagatggcaaaaccagatgcttccccagatgccgttccgcaagatggagctctctggagtgctggttacttctgcgcccaagccagtgggctgtctctcctggatgccaaattagggaagcactccctgattagtatccacgtgacct

SEQ ID NO: 288133 - DNA, 2920 bp, Homo sapiens
gagactgtgttaggggcgggggtatggaacgtagtggaaagggcagaaatttggatctcagttcgcgcccaccccgcaggcgcctcccgcgagccgggccctctgtgagtgagacaagctccccttcctttacgcgcctcacctggcgcgtggggagaggtcggcagccctccgccgcagaacctccggaagggatgtcctctgccctgcgcctctggccggggctgtggtccctccaggccgtcgaggggatgctgaggccggtccccagaggagcatgacttggctggtccggaggagctctgagggcatgggcaatcttggctcgctgcaacctcagcttccagagttcaagcgagtctcctgcttcagcctcatgagtagctgggactacagatgcgtgccactacgtccgtctgatgtttgtatttttagtagagacagggtttcaccatgttggtcaggctgctctcgaactccagatctcgtgatccgcccgcctgggcctactaaagtgctgggattacaggcgtgagctagatctgactttctagtgtcctagccttggcccgatggacatgtcatttctctcagctcgtttctgtcccctaaagtgagaatattgcctgggaagattacattagacgatgtatatgcgaagacacttgatagctggtattgtcatgattctgattatttcactactgctactttccctgtggcctaggctttgcctatttccagtgggcgagctagctagatcctcctcccttaaataagccagtgtttttaagacagaatactacttgcatagtggacaataatatcttaaagaactgagcaggatgaaaagaatttgatagaaagcaggtttgaggagcacattggaggttggcaggtttcgaggctgcttgagaggacttgggccgatctgggctgggcttggacgtgaccctggcacccaggcaggtggatcccagctggggcttccattcacgactttctggtccctggcaggacagagcgggatgccaccagcttgtccaaagggaagttccaggagctcctggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggcatcgttaaagaatctggagtgaagcacaagggattgattgaaatacccaatctttctgaggaaaatgaagtagatgacactgagaatttacaacgggaatgattttaccaacgaaagctatggcaacccaggaattgactgtcaaaagaaaactgagtgggaataccctgcaggttcaggcctcatctccagtggcactgggtgtaaggattcccactgtggctcttcacatgatggaactgtttgacacaactgtagagcagctgtatagcatcttcactgtaaaggaggtaagtaactccctaagctagcatgttaagtgctgacattgggagaaaatacattacaaagaacaggagctggtttttggttttccttgtggctgtgtttttgattgaagggatgtgggatggtggtgacagaagtctgagcatagtttctgaataattggaggggagatgggcattctttgggactatgtccgcattacattgagttttctccctctaggaagagagagtttgtgttttattttctgtaagtaaaagctacatgtttaggatttttaaaccatattaattgttatattttgtatttcataattatattatgtgttagtgtgtactggaataacatgttttatttggttagttggtgcaaaagttttctaaatctactgctgtattagaaactgaaaagggagggaaattccagatgtttgatgggaacatcactggtgaatatctaggattggtaagtagactcaaggttgaagaagtaaggtgggattaactcttaatattactttttgtatatgctgtttttagcaccgaaatcacgagggtctgtgttgcctcaaccttaacagcagccctctgttctggttactattactgtacttaaaacattattatatattcctgctgtccttgatgttactgctgttctgagacattttggcaataaagacaattatcagtggtgctgatgtataaactggaagaaggaccgtatgttgttcattgattcttctaggagtttcaatgaaaggatttttctgtgttgtattgtgggaagtcttaaaagattttcagtggaatttcccctctcttttcagttaacaaataagaagatcatcatgaaatggagatgtgggaactggccagaagaacactatgccatggttgcactgaattttgtgcctactctagggcaaacagaattacaattgaaggagttcctatctatctgtaaagaagagaacatgaaattctgttggcagaagcagcattttgaagaaataaaaggttcactgcagctgacccccctaaatggttgaattaaaatttattataaggcattactttttgtaagcggaaaaagtgtcacatttacctcttccctatcttttgtttaaaaggactgtctttattttatattggatgaaatctatgaacatatatacaatgtaaagcattgtttgactctttattataactagacactgcattgatttaaaagtagcaaacaacctgaaattaagtattaacctgaccttccatcgatattcctctggaaataggtaagtcctgagtgcagatagttgatgtttcccaagctgaagcttgtcctatagcaagcttgcttgcagctgtacttttagttcaagatgacaaaaaataaatggcatgttgacactaaaaaaaaaaa

SEQ ID NO: 288134 - DNA, 2193 bp, Homo sapiens
acttcccccgcgcgcacttgcctaaagaaatccatcctcctcccttaaataagccagtgtttttaagacagaatactacttgcatagtggacaataatatcttaaagaactgagcaggatgaaaagaatttgatagaaagcaggtttgaggagcacattggaggttggcaggtttcgaggctgcttgagaggacttgggccgatctgggctgggcttggacgtgaccctggcacccaggcaggtggatcccagctggggcttccattcacgactttctggtccctggcaggacagagcgggatgccaccagcttgtccaaagggaagttccaggagctcctggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggcatcgttaaagaatctggagtgaagcacaagggattgattgaaatacccaatctttctgaggaaaatgaagtagatgacactgagaatttacaacgggaatgattttaccaacgaaagctatggcaacccaggaattgactgtcaaaagaaaactgagtgggaataccctgcaggttcaggcctcatctccagtggcactgggtgtaaggattcccactgtggctcttcacatgatggaactgtttgacacaactgtagagcagctgtatagcatcttcactgtaaaggaggtaagtaactccctaagctagcatgttaagtgctgacattgggagaaaatacattacaaagaacaggagctggtttttggttttccttgtggctgtgtttttgattgaagggatgtgggatggtggtgacagaagtctgagcatagtttctgaataattggaggggagatgggcattctttgggactatgtccgcattacattgagttttctccctctaggaagagagagtttgtgttttattttctgtaagtaaaagctacatgtttaggatttttaaaccatattaattgttatattttgtatttcataattatattatgtgttagtgtgtactggaataacatgttttatttggttagttggtgcaaaagttttctaaatctactgctgtattagaaactgaaaagggagggaaattccagatgtttgatgggaacatcactggtgaatatctaggattggtaagtagactcaaggttgaagaagtaaggtgggattaactcttaatattactttttgtatatgctgtttttagcaccgaaatcacgagggtctgtgttgcctcaaccttaacagcagccctctgttctggttactattactgtacttaaaacattattatatattcctgctgtccttgatgttactgctgttctgagacattttggcaataaagacaattatcagtggtgctgatgtataaactggaagaaggaccgtatgttgttcattgattcttctaggagtttcaatgaaaggatttttctgtgttgtattgtgggaagtcttaaaagattttcagtggaatttcccctctcttttcagttaacaaataagaagatcatcatgaaatggagatgtgggaactggccagaagaacactatgccatggttgcactgaattttgtgcctactctagggcaaacagaattacaattgaaggagttcctatctatctgtaaagaagagaacatgaaattctgttggcagaagcagcattttgaagaaataaaaggttcactgcagctgacccccctaaatggttgaattaaaatttattataaggcattactttttgtaagcggaaaaagtgtcacatttacctcttccctatcttttgtttaaaaggactgtctttattttatattggatgaaatctatgaacatatatacaatgtaaagcattgtttgactctttattataactagacactgcattgatttaaaagtagcaaacaacctgaaattaagtattaacctgaccttccatcgatattcctctggaaataggtaagtcctgagtgcagatagttgatgtttcccaagctgaagcttgtcctatagcaagcttgcttgcagctgtacttttagttcaagatgacaaaaaataaatggcatgttgacactaaaaaaaaaaa

SEQ ID NO: 288135 - DNA, 3039 bp, Homo sapiens
gagactgtgttaggggcgggggtatggaacgtagtggaaagggcagaaatttggatctcagttcgcgcccaccccgcaggcgcctcccgcgagccgggccctctgtgagtgagacaagctccccttcctttacgcgcctcacctggcgcgtggggagaggtcggcagccctccgccgcagaacctccggaagggatgtcctctgccctgcgcctctggccggggctgtggtccctccaggccgtcgaggggatgctgaggccggtccccagaggagcatgacttggctggtccggaggagctctgagggcatgggcaatcttggctcgctgcaacctcagcttccagagttcaagcgagtctcctgcttcagcctcatgagtagctgggactacagatgcgtgccactacgtccgtctgatgtttgtatttttagtagagacagggtttcaccatgttggtcaggctgctctcgaactccagatctcgtgatccgcccgcctgggcctactaaagtgctgggattacaggcgtgagctagatctgactttctagtgtcctagccttggcccgatggacatgtcatttctctcagctcgtttctgtcccctaaagtgagaatattgcctgggaagattacattagacgatgtatatgcgaagacacttgatagctggtattgtcatgattctgattatttcactactgctactttccctgtggcctaggctttgcctatttccagtgggcgagctagctagatcctcctcccttaaataagccagtgtttttaagacagaatactacttgcatagtggacaataatatcttaaagaactgagcaggatgaaaagaatttgatagaaagcaggtttgaggagcacattggaggttggcaggtttcgaggctgcttgagaggacttgggccgatctgggctgggcttggacgtgaccctggcacccaggcaggtggatcccagctggggcttccattcacgactttctggtccctggcaggacagagcgggatgccaccagcttgtccaaagggaagttccaggagctcctggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggcatcgttaaagaatctggagtgaagcacaagggattgattgaaatacccaatctttctgaggaaaatgaagtagatgacactgagaatttacaacgggaatgattttaccaacgaaagctatggcaacccaggaattgactgtcaaaagaaaactgagtgggaataccctgcaggttcaggcctcatctccagtggcactgggtgtaaggattcccactgtggctcttcacatgatggaactgtttgacacaactgtagagcagctgtatagcatcttcactgtaaaggaggtaagtaactccctaagctagcatgttaagtgctgacattgggagaaaatacattacaaagaacaggagctggtttttggttttccttgtggctgtgtttttgattgaagggatgtgggatggtggtgacagaagtctgagcatagtttctgaataattggaggggagatgggcattctttgggactatgtccgcattacattgagttttctccctctaggaagagagagtttgtgttttattttctgtaagtaaaagctacatgtttaggatttttaaaccatattaattgttatattttgtatttcataattatattatgtgttagtgtgtactggaataacatgttttatttggttagttggtgcaaaagttttctaaatctactgctgtattagaaactgaaaagggagggaaattccagatgtttgatgggaacatcactggtgaatatctaggattggtaagtagactcaaggttgaagaagtaaggtgggattaactcttaatattactttttgtatatgctgtttttagcaccgaaatcacgagggtctgtgttgcctcaaccttaacagcagccctctgttctggttactattactgtacttaaaacattattatatattcctgctgtccttgatgttactgctgttctgagacattttggcaataaagacaattatcagtggtgctgatgtataaactggaagaaggaccgtatgttgttcattgattcttctaggagtttcaatgaaaggatttttctgtgttgtattgtgggaagtcttaaaagattttcagtggaatttcccctctcttttcagttaacaaataagaagatcatcatgaaatggagatgtgggaactggccagaaggtatgttactaattactgcccttcatattaaaggtcccaaaacactaaggctaggtttttcgtatggataaattttccttttcataatgcggtaataaggttcctattttttttcttagaacactatgccatggttgcactgaattttgtgcctactctagggcaaacagaattacaattgaaggagttcctatctatctgtaaagaagagaacatgaaattctgttggcagaagcagcattttgaagaaataaaaggttcactgcagctgacccccctaaatggttgaattaaaatttattataaggcattactttttgtaagcggaaaaagtgtcacatttacctcttccctatcttttgtttaaaaggactgtctttattttatattggatgaaatctatgaacatatatacaatgtaaagcattgtttgactctttattataactagacactgcattgatttaaaagtagcaaacaacctgaaattaagtattaacctgaccttccatcgatattcctctggaaataggtaagtcctgagtgcagatagttgatgtttcccaagctgaagcttgtcctatagcaagcttgcttgcagctgtacttttagttcaagatgacaaaaaataaatggcatgttgacactaaaaaaaaaaa

SEQ ID NO: 288136 - DNA, 2195 bp, Homo sapiens
gagactgtgttaggggcgggggtatggaacgtagtggaaagggcagaaatttggatctcagttcgcgcccaccccgcaggcgcctcccgcgagccgggccctctgtgagtgagacaagctccccttcctttacgcgcctcacctggcgcgtggggagaggtcggcagccctccgccgcagaacctccggaagggatgtcctctgccctgcgcctctggccggggctgtggtccctccaggccgtcgaggggatgctgaggccggtccccagaggagcatgacttggctggtccggaggagctctgagggcatgggcaatcttggctcgctgcaacctcagcttccagagttcaagcgagtctcctgcttcagcctcatgagtagctgggactacagatgcgtgccactacgtccgtctgatgtttgtatttttagtagagacagggtttcaccatgttggtcaggctgctctcgaactccagatctcgtgatccgcccgcctgggcctactaaagtgctgggattacaggcgtgagctagatctgactttctagtgtcctagccttggcccgatggacatgtcatttctctcagctcgtttctgtcccctaaagtgagaatattgcctgggaagattacattagacgatgtatatgcgaagacacttgatagctggtattgtcatgattctgattatttcactactgctactttccctgtggcctaggctttgcctatttccagtgggcgagctagctagatcctcctcccttaaataagccagtgtttttaagacagaatactacttgcatagtggacaataatatcttaaagaactgagcaggatgaaaagaatttgatagaaagcaggtttgaggagcacattggaggttggcaggtttcgaggctgcttgagaggacttgggccgatctgggctgggcttggacgtgaccctggcacccaggcaggtggatcccagctggggcttccattcacgactttctggtccctggcaggacagagcgggatgccaccagcttgtccaaagggaagttccaggagctcctggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggcatcgttaaagaatctggagtgaagcacaagggattgattgaaatacccaatctttctgaggaaaatgaagtagatgacactgagaatttacaacgggaatgattttaccaacgaaagctatggcaacccaggaattgactgtcaaaagaaaactgagtgggaataccctgcaggttcaggcctcatctccagtggcactgggtgtaaggattcccactgtggctcttcacatgatggaactgtttgacacaactgtagagcagctgtatagcatcttcactgtaaaggagttggtgcaaaagttttctaaatctactgctgtattagaaactgaaaagggagggaaattccagatgtttgatgggaacatcactggtgaatatctaggattgttaacaaataagaagatcatcatgaaatggagatgtgggaactggccagaagaacactatgccatggttgcactgaattttgtgcctactctagggcaaacagaattacaattgaaggagttcctatctatctgtaaagaagagaacatgaaattctgttggcagaagcagcattttgaagaaataaaaggttcactgcagctgacccccctaaatggttgaattaaaatttattataaggcattactttttgtaagcggaaaaagtgtcacatttacctcttccctatcttttgtttaaaaggactgtctttattttatattggatgaaatctatgaacatatatacaatgtaaagcattgtttgactctttattataactagacactgcattgatttaaaagtagcaaacaacctgaaattaagtattaacctgaccttccatcgatattcctctggaaataggtaagtcctgagtgcagatagttgatgtttcccaagctgaagcttgtcctatagcaagcttgcttgcagctgtacttttagttcaagatgacaaaaaataaatggcatgttgacactaaaaaaaaaaa

SEQ ID NO: 288137 - DNA, 2120 bp, Homo sapiens
gagactgtgttaggggcgggggtatggaacgtagtggaaagggcagaaatttggatctcagttcgcgcccaccccgcaggcgcctcccgcgagccgggccctctgtgagtgagacaagctccccttcctttacgcgcctcacctggcgcgtggggagaggtcggcagccctccgccgcagaacctccggaagggatgtcctctgccctgcgcctctggccggggctgtggtccctccaggccgtcgaggggatgctgaggccggtccccagaggagcatgacttggctggtccggaggagctctgagggcatgggcaatcttggctcgctgcaacctcagcttccagagttcaagcgagtctcctgcttcagcctcatgagtagctgggactacagatgcgtgccactacgtccgtctgatgtttgtatttttagtagagacagggtttcaccatgttggtcaggctgctctcgaactccagatctcgtgatccgcccgcctgggcctactaaagtgctgggattacaggcgtgagctagatctgactttctagtgtcctagccttggcccgatggacatgtcatttctctcagctcgtttctgtcccctaaagtgagaatattgcctgggaagattacattagacgatgtatatgcgaagacacttgatagctggtattgtcatgattctgattatttcactactgctactttccctgtggcctaggctttgcctatttccagtgggcgagctagctagatcctcctcccttaaataagccagtgtttttaagacagaatactacttgcatagtggacaataatatcttaaagaactgagcaggatgaaaagaatttgatagaaagcaggtttgaggagcacattggaggttggcaggtttcgaggctgcttgagaggacttgggccgatctgggctgggcttggacgtgaccctggcacccaggcaggtggatcccagctggggcttccattcacgactttctggtccctggcaggacagagcgggatgccaccagcttgtccaaagggaagttccaggagctcctggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggcatcgttaaagaatctggagtgaagcacaagggattgattgaaatacccaatctttctgaggaaaatgaagtagatgacactgagaatttacaacgggaatgattttaccaacgaaagctatggcaacccaggaattgactgtcaaaagaaaactgagtgggaataccctgcaggttcaggcctcatctccagtggcactgggtgtaaggattcccactgtggctcttcacatgatggaactgtttgacacaactgtagagcagctgtatagcatcttcactgtaaaggaggaagagagagtttgtgttttattttctttaacaaataagaagatcatcatgaaatggagatgtgggaactggccagaagaacactatgccatggttgcactgaattttgtgcctactctagggcaaacagaattacaattgaaggagttcctatctatctgtaaagaagagaacatgaaattctgttggcagaagcagcattttgaagaaataaaaggttcactgcagctgacccccctaaatggttgaattaaaatttattataaggcattactttttgtaagcggaaaaagtgtcacatttacctcttccctatcttttgtttaaaaggactgtctttattttatattggatgaaatctatgaacatatatacaatgtaaagcattgtttgactctttattataactagacactgcattgatttaaaagtagcaaacaacctgaaattaagtattaacctgaccttccatcgatattcctctggaaataggtaagtcctgagtgcagatagttgatgtttcccaagctgaagcttgtcctatagcaagcttgcttgcagctgtacttttagttcaagatgacaaaaaataaatggcatgttgacactaaaaaaaaaaa

SEQ ID NO: 288138 - DNA, 1586 bp, Homo sapiens
gagactgtgttaggggcgggggtatggaacgtagtggaaagggcagaaatttggatctcagttcgcgcccaccccgcaggcgcctcccgcgagccgggccctctgtgagtgagacaagctccccttcctttacgcgcctcacctggcgcgtggggagaggtcggcagccctccgccgcagaacctccggaagggatgtcctctgccctgcgcctctggccggggctgtggtccctccaggccgtcgaggggatgctgaggccggtccccagaggagcatgacttggctggtccggaggagctctgagggcatgggcaatcttggctcgctgcaacctcagcttccagagttcaagcgagtctcctgcttcagcctcatgagtagctgggactacagatgcgtgccactacgtccgtctgatgtttgtatttttagtagagacagggtttcaccatgttggtcaggctgctctcgaactccagatctcgtgatccgcccgcctgggcctactaaagtgctgggattacaggcgtgagctagatctgactttctagtgtcctagccttggcccgatggacatgtcatttctctcagctcgtttctgtcccctaaagtgagaatattgcctgggaagattacattagacgatgtatatgcgaagacacttgatagctggtattgtcatgattctgattatttcactactgctactttccctgtggcctaggctttgcctatttccagtgggcgagctagctagatcctcctcccttaaataagccagtgtttttaagacagaatactacttgcatagtggacaataatatcttaaagaactgagcaggatgaaaagaatttgatagaaagcaggtttgaggagcacattggaggttggcaggtttcgaggctgcttgagaggacttgggccgatctgggctgggcttggacgtgaccctggcacccaggcaggtggatcccagctggggcttccattcacgactttctggtccctggcaggacagagcgggatgccaccagcttgtccaaagggaagttccaggagctcctggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggcatcgttaaagaatctggagtgaagcacaagggattgattgaaatacccaatctttctgaggaaaatgaagtagatgacactgaggtatgtgatcaagtttctatttcttttgttcttttttcagtcaagcttctgctacagacattgggcatttcaaatagtgttgatcagactgtgtggttcctgtgtggtagttcgggtgccttgtggagggcctgtttgccgagaaggattgccgtactgtgggggcagcgtgttgtgtggagctggagtggtacaggaaagagagtaagccccaggaagccctgagctcccccgaggaccaggcaaggggcctgggcagctggctgcaccctccttagcctcctcatctgtg

SEQ ID NO: 288139 - DNA, 2093 bp, Homo sapiens
gagactgtgttaggggcgggggtatggaacgtagtggaaagggcagaaatttggatctcagttcgcgcccaccccgcaggcgcctcccgcgagccgggccctctgtgagtgagacaagctccccttcctttacgcgcctcacctggcgcgtggggagaggtcggcagccctccgccgcagaacctccggaagggatgtcctctgccctgcgcctctggccggggctgtggtccctccaggccgtcgaggggatgctgaggccggtccccagaggagcatgacttggctggtccggaggagctctgagggcatgggcaatcttggctcgctgcaacctcagcttccagagttcaagcgagtctcctgcttcagcctcatgagtagctgggactacagatgcgtgccactacgtccgtctgatgtttgtatttttagtagagacagggtttcaccatgttggtcaggctgctctcgaactccagatctcgtgatccgcccgcctgggcctactaaagtgctgggattacaggcgtgagctagatctgactttctagtgtcctagccttggcccgatggacatgtcatttctctcagctcgtttctgtcccctaaagtgagaatattgcctgggaagattacattagacgatgtatatgcgaagacacttgatagctggtattgtcatgattctgattatttcactactgctactttccctgtggcctaggctttgcctatttccagtgggcgagctagctagatcctcctcccttaaataagccagtgtttttaagacagaatactacttgcatagtggacaataatatcttaaagaactgagcaggatgaaaagaatttgatagaaagcaggtttgaggagcacattggaggttggcaggtttcgaggctgcttgagaggacttgggccgatctgggctgggcttggacgtgaccctggcacccaggcaggtggatcccagctggggcttccattcacgactttctggtccctggcaggacagagcgggatgccaccagcttgtccaaagggaagttccaggagctcctggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggcatcgttaaagaatctggagtgaagcacaagggattgattgaaatacccaatctttctgaggaaaatgaagtagatgacactgagaatttacaacgggaatgattttaccaacgaaagctatggcaacccaggaattgactgtcaaaagaaaactgagtgggaataccctgcaggttcaggcctcatctccagtggcactgggtgtaaggattcccactgtggctcttcacatgatggaactgtttgacacaactgtagagcagctgtatagcatcttcactgtaaaggagttaacaaataagaagatcatcatgaaatggagatgtgggaactggccagaagaacactatgccatggttgcactgaattttgtgcctactctagggcaaacagaattacaattgaaggagttcctatctatctgtaaagaagagaacatgaaattctgttggcagaagcagcattttgaagaaataaaaggttcactgcagctgacccccctaaatggttgaattaaaatttattataaggcattactttttgtaagcggaaaaagtgtcacatttacctcttccctatcttttgtttaaaaggactgtctttattttatattggatgaaatctatgaacatatatacaatgtaaagcattgtttgactctttattataactagacactgcattgatttaaaagtagcaaacaacctgaaattaagtattaacctgaccttccatcgatattcctctggaaataggtaagtcctgagtgcagatagttgatgtttcccaagctgaagcttgtcctatagcaagcttgcttgcagctgtacttttagttcaagatgacaaaaaataaatggcatgttgacactaaaaaaaaaaa

SEQ ID NO: 288140 - DNA, 2878 bp, Homo sapiens
gagactgtgttaggggcgggggtatggaacgtagtggaaagggcagaaatttggatctcagttcgcgcccaccccgcaggcgcctcccgcgagccgggccctctgtgagtgagacaagctccccttcctttacgcgcctcacctggcgcgtggggagaggtcggcagccctccgccgcagaacctccggaagggatgtcctctgccctgcgcctctggccggggctgtggtccctccaggccgtcgaggggatgctgaggccggtccccagaggagcatgacttggctggtccggaggagctctgagggcatgggcaatcttggctcgctgcaacctcagcttccagagttcaagcgagtctcctgcttcagcctcatgagtagctgggactacagatgcgtgccactacgtccgtctgatgtttgtatttttagtagagacagggtttcaccatgttggtcaggctgctctcgaactccagatctcgtgatccgcccgcctgggcctactaaagtgctgggattacaggcgtgagctagatctgactttctagtgtcctagccttggcccgatggacatgtcatttctctcagctcgtttctgtcccctaaagtgagaatattgcctgggaagattacattagacgatgtatatgcgaagacacttgatagctggtattgtcatgattctgattatttcactactgctactttccctgtggcctaggctttgcctatttccagtgggcgagctagctagatcctcctcccttaaataagccagtgtttttaagacagaatactacttgcatagtggacaataatatcttaaagaactgagcaggatgaaaagaatttgatagaaagcaggtttgaggagcacattggaggttggcaggtttcgaggctgcttgagaggacttgggccgatctgggctgggcttggacgtgaccctggcacccaggcaggtggatcccagctggggcttccattcacgactttctggtccctggcaggacagagcgggatgccaccagcttgtccaaagggaagttccaggagctcctggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggcatcgttaaagaatctggagtgaagcacaagggattgattgaaatacccaatctttctgaggaaaatgaagtagatgacactgagaatttacaacgggaatgattttaccaacgaaagctatggcaacccaggaattgactgtcaaaagaaaactgagtgggaataccctgcaggttcaggcctcatctccagtggcactgggtgtaaggattcccactgtggctcttcacatgatggaactgtttgacacaactgtagagcagctgtatagcatcttcactgtaaaggaggtaagtaactccctaagctagcatgttaagtgctgacattgggagaaaatacattacaaagaacaggagctggtttttggttttccttgtggctgtgtttttgattgaagggatgtgggatggtggtgacagaagtctgagcatagtttctgaataattggaggggagatgggcattctttgggactatgtccgcattacattgagttttctccctctaggaagagagagtttgtgttttattttctgtaagtaaaagctacatgtttaggatttttaaaccatattaattgttatattttgtatttcataattatattatgtgttagtgtgtactggaataacatgttttatttggttagttggtgcaaaagttttctaaatctactgctgtattagaaactgaaaagggagggaaattccagatgtttgatgggaacatcactggtgaatatctaggattggtaagtagactcaaggttgaagaagtaaggtgggattaactcttaatattactttttgtatatgctgtttttagcaccgaaatcacgagggtctgtgttgcctcaaccttaacagcagccctctgttctggttactattactgtacttaaaacattattatatattcctgctgtccttgatgttactgctgttctgagacattttggcaataaagacaattatcagtggtgctgatgtataaactggaagaaggaccgtatgttgttcattgattcttctaggagtttcaatgaaaggatttttctgtgttgtattgtgggaagtcttaaaagattttcagtggaatttcccctctcttttcagttaacaaataagaagatcatcatgaaatggagatgtgggaactggccagaagggcaaacagaattacaattgaaggagttcctatctatctgtaaagaagagaacatgaaattctgttggcagaagcagcattttgaagaaataaaaggttcactgcagctgacccccctaaatggttgaattaaaatttattataaggcattactttttgtaagcggaaaaagtgtcacatttacctcttccctatcttttgtttaaaaggactgtctttattttatattggatgaaatctatgaacatatatacaatgtaaagcattgtttgactctttattataactagacactgcattgatttaaaagtagcaaacaacctgaaattaagtattaacctgaccttccatcgatattcctctggaaataggtaagtcctgagtgcagatagttgatgtttcccaagctgaagcttgtcctatagcaagcttgcttgcagctgtacttttagttcaagatgacaaaaaataaatggcatgttgacactaaaaaaaaaaa

SEQ ID NO: 288141 - DNA, 2212 bp, Homo sapiens
gagactgtgttaggggcgggggtatggaacgtagtggaaagggcagaaatttggatctcagttcgcgcccaccccgcaggcgcctcccgcgagccgggccctctgtgagtgagacaagctccccttcctttacgcgcctcacctggcgcgtggggagaggtcggcagccctccgccgcagaacctccggaagggatgtcctctgccctgcgcctctggccggggctgtggtccctccaggccgtcgaggggatgctgaggccggtccccagaggagcatgacttggctggtccggaggagctctgagggcatgggcaatcttggctcgctgcaacctcagcttccagagttcaagcgagtctcctgcttcagcctcatgagtagctgggactacagatgcgtgccactacgtccgtctgatgtttgtatttttagtagagacagggtttcaccatgttggtcaggctgctctcgaactccagatctcgtgatccgcccgcctgggcctactaaagtgctgggattacaggcgtgagctagatctgactttctagtgtcctagccttggcccgatggacatgtcatttctctcagctcgtttctgtcccctaaagtgagaatattgcctgggaagattacattagacgatgtatatgcgaagacacttgatagctggtattgtcatgattctgattatttcactactgctactttccctgtggcctaggctttgcctatttccagtgggcgagctagctagatcctcctcccttaaataagccagtgtttttaagacagaatactacttgcatagtggacaataatatcttaaagaactgagcaggatgaaaagaatttgatagaaagcaggtttgaggagcacattggaggttggcaggtttcgaggctgcttgagaggacttgggccgatctgggctgggcttggacgtgaccctggcacccaggcaggtggatcccagctggggcttccattcacgactttctggtccctggcaggacagagcgggatgccaccagcttgtccaaagggaagttccaggagctcctggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggcatcgttaaagaatctggagtgaagcacaagggattgattgaaatacccaatctttctgaggaaaatgaagtagatgacactgagaatttacaacgggaatgattttaccaacgaaagctatggcaacccaggaattgactgtcaaaagaaaactgagtgggaataccctgcaggttcaggcctcatctccagtggcactgggtgtaaggattcccactgtggctcttcacatgatggaactgtttgacacaactgtagagcagctgtatagcatcttcactgtaaaggagttaacaaataagaagatcatcatgaaatggagatgtgggaactggccagaaggtatgttactaattactgcccttcatattaaaggtcccaaaacactaaggctaggtttttcgtatggataaattttccttttcataatgcggtaataaggttcctattttttttcttagaacactatgccatggttgcactgaattttgtgcctactctagggcaaacagaattacaattgaaggagttcctatctatctgtaaagaagagaacatgaaattctgttggcagaagcagcattttgaagaaataaaaggttcactgcagctgacccccctaaatggttgaattaaaatttattataaggcattactttttgtaagcggaaaaagtgtcacatttacctcttccctatcttttgtttaaaaggactgtctttattttatattggatgaaatctatgaacatatatacaatgtaaagcattgtttgactctttattataactagacactgcattgatttaaaagtagcaaacaacctgaaattaagtattaacctgaccttccatcgatattcctctggaaataggtaagtcctgagtgcagatagttgatgtttcccaagctgaagcttgtcctatagcaagcttgcttgcagctgtacttttagttcaagatgacaaaaaataaatggcatgttgacactaaaaaaaaaaa

SEQ ID NO: 288142 - DNA, 3231 bp, Homo sapiens
acagagcgctcccttggaggcacccagggacctggccagccgtgcagctgcccaggcgctatggcgagtgcggtcagggggtcgaggccgtggccccggctggggctccagctccagttcgcggcgctgctgctcgggacgctgagtccacaggttcacactctcaggccagagaacctcctgctggtgtccaccttggatggaagtctccacgcactaagcaagcagacaggggacctgaagtggactctgagggatgatcccgtcatcgaaggaccaatgtacgtcacagaaatggcctttctctctgacccagcggatggcagcctgtacatcttggggacccaaaaacaactgggattaatgaaactgccattcaccatccctgagctggttcatgcttctccctgccgcagctctgatggggtcttctacacaggccggaagcaggatgcctggtttgtggtggaccctgagtcaggggagacccagatgacactgaccacagcgggtccctccaccccccgcctctacatcggccgaacacagtatacggtcaccatgcatgacccaagagccccagccctgcgctggaacaccacctaccgccgctactcagcgccccccatggatggctcacctgggaaatacatgagccacctggcgtcctgtgggatgggcctgctgctcactgtggacccagaaagtggggcagtgctgtggacacaagacctgggcatgcctgtgatgggcgtttacacctggcaccaggacggcctgcgccagctgccgcatctcaccctggctcgagacactctgcatttcctcgccctccgctggggccacatccgactgcctgcctcaggcccccaggacacagccaccctcttctctgccttggatacccagctgctgatgacactgtatgtagggaaggatgaaactggcttctatgtctctaaagcactggtccacacaggagtggccctggtgcctcgtggactgaccctggcccccgcagatggccccaccacagatgaggtgacactccaagtctcaggagagcgagagggctcacccagcactgctgttagatacccctcaggcagtgtggccctcccaagccagtggctgctcattggacaccacgagctacccccagtcctgcacaccaccatgctgagggtccatcccaccctggggagtggaactgcagagacaagacctccagagaatacccaggccccagccttcttcttggagctattgagcctgagccgagagaaactttgggactccgagctgcatccagaagaaaaaactccagactcttacttggggctgggaccccaagacctgctggcagctagcctcactgctgtcctcctgggagggtggattctctttgtgatgaggcagcaacagccgcaggtggtggagaagcagcaggagacccccctggcacctgcagactttgctcacatctcccaggatgcccagtccctgcactcgggggccacccggaggagccagaagaggcttcagagtccctcaaagcaagcccagccactcgacgaccctgaagctgagcaactcaccgtagtggggaagatttccttcaatcccaaggacgtgctgggccacggggcaggcgggactttcgttttccggggacagtttgagggacgggcagtggctgtcaagcggctcctccgcgagtgctttggcctggttcggcgggaagttcaactgctgcaggagtctgacaggcaccccaacgtgctccgctacttctgcaccgagcggggaccccagttccactacattgccctggagctctgccgggcctccttgcaggagtacgtagaaaacccggacctggatcgcgggggcctggagcccgaggtcgtgctgcagcagctgatgtctggcctggcccacctgcactctttacacatagtgcaccgggacctgaagccaggaaatattctcatcaccgggcctgacagccagggcctgggcagagtggtgctctcagacttcggcctctgcaagaagctgcctgctggccgctgtagcttcagcctccactccggcatccccggcacggaaggctggatggcgcccgagcttctgcagctcctgccaccagacagtcctaccagcgctgtggacatcttctctgcaggctgcgtgttctactacgtgctttctggtggcagccacccctttggagacagtctttatcgccaggcaaacatcctcacaggggttccctgtctggctcacctggaggaagaggtccacgacaaggtggttgcccgggacctggttggagccatgttgagcccactgccgcagccacgcccctctgccccccaggtgctggcccaccccttcttttggagcagagccaagcaactccagttcttccaggacgtcagtgactggctggagaaggagtccgagcaggagcccctggtgagggcactggaggcgggaggctgcgcagtggtccgggacaactggcacgagcacatctccatgccgctgcagacagatctgagaaagttccggtcctataaggggacatcagtgcgagacctgctccgtgctgtgaggaacaagaagcaccactacagggagctcccagttgaggtgcgacaggcactcggccaagtccctgatggcttcgtccagtacttcacaaaccgcttcccacggctgctcctccacacgcaccgagccatgaggagctgcgcctctgagagcctcttcctgccctactacccaccagactcagaggccagggggccgtgccctggggctgcagggaggtgaagtgggccggaggccacacaaatggtctccatgctggctcactgaagagctgagcctgtggctggcctcagaatcaggctgggtgcagtggctcacacctgtaatcccagcattttgggaggctgaggtgggagaatcacttgagcccaggagttcgaggctgcagtgagccaggatcatgccactgcactccagcctggtccacagagagacactgtcaccccctttcccccacaagactggcagaggctgggcagcctggggctgatgaagcagagatgttcgctggatcccaggccctggcacccctcaggaaatacaagaaaaagaatattcacatctgtttaatgtgcataaagccaaggaaaggacagttccgaattcaataga

SEQ ID NO: 288143 - DNA, 3156 bp, Homo sapiens
tgacactgggtgtgggaatttctgcatttcctcaagaggctgtgtagcaaaatgattcagtgtgctggctctggagcctgactgcctgggttcaaggccaggctctgccatttagtagctgtgtgacattagccaagttacatggcctctccaagccccagtttccttacctgaaaagtggaaatgatagtaatacctgttaattggttgctatggaaatgggctcacctggcacagtgagcactgtgtgttgctgctcttactccttcctgtaaattttccgtctcctagaaactgccattcaccatccctgagctggttcatgcttctccctgccgcagctctgatggggtcttctacacaggccggaagcaggatgcctggtttgtggtggaccctgagtcaggggagacccagatgacactgaccacagcgggtccctccaccccccgcctctacatcggccgaacacagtatacggtcaccatgcatgacccaagagccccagccctgcgctggaacaccacctaccgccgctactcagcgccccccatggatggctcacctgggaaatacatgagccacctggcgtcctgtgggatgggcctgctgctcactgtggacccagaaagtggggcagtgctgtggacacaagacctgggcatgcctgtgatgggcgtttacacctggcaccaggacggcctgcgccagctgccgcatctcaccctggctcgagacactctgcatttcctcgccctccgctggggccacatccgactgcctgcctcaggcccccaggacacagccaccctcttctctgccttggatacccagctgctgatgacactgtatgtagggaaggatgaaactggcttctatgtctctaaagcactggtccacacaggagtggccctggtgcctcgtggactgaccctggcccccgcagatggccccaccacagatgaggtgacactccaagtctcaggagagcgagagggctcacccagcactgctgttagatacccctcaggcagtgtggccctcccaagccagtggctgctcattggacaccacgagctacccccagtcctgcacaccaccatgctgagggtccatcccaccctggggagtggaactgcagagacaagacctccagagaatacccaggccccagccttcttcttggagctattgagcctgagccgagagaaactttgggactccgagctgcatccagaagaaaaaactccagactcttacttggggctgggaccccaagacctgctggcagctagcctcactgctgtcctcctgggagggtggattctctttgtgatgaggcagcaacagccgcaggtggtggagaagcagcaggagacccccctggcacctgcagactttgctcacatctcccaggatgcccagtccctgcactcgggggccacccggaggagccagaagaggcttcagagtccctcaaagcaagcccagccactcgacgaccctgaagctgagcaactcaccgtagtggggaagatttccttcaatcccaaggacgtgctgggccacggggcaggcgggactttcgttttccggggacagtttgagggacgggcagtggctgtcaagcggctcctccgcgagtgctttggcctggttcggcgggaagttcaactgctgcaggagtctgacaggcaccccaacgtgctccgctacttctgcaccgagcggggaccccagttccactacattgccctggagctctgccgggcctccttgcaggagtacgtagaaaacccggacctggatcgcgggggcctggagcccgaggtcgtgctgcagcagctgatgtctggcctggcccacctgcactctttacacatagtgcaccgggacctgaagccaggaaatattctcatcaccgggcctgacagccagggcctgggcagagtggtgctctcagacttcggcctctgcaagaagctgcctgctggccgctgtagcttcagcctccactccggcatccccggcacggaaggctggatggcgcccgagcttctgcagctcctgccaccagacagtcctaccagcgctgtggacatcttctctgcaggctgcgtgttctactacgtgctttctggtggcagccacccctttggagacagtctttatcgccaggcaaacatcctcacaggggttccctgtctggctcacctggaggaagaggtccacgacaaggtggttgcccgggacctggttggagccatgttgagcccactgccgcagccacgcccctctgccccccaggtgctggcccaccccttcttttggagcagagccaagcaactccagttcttccaggacgtcagtgactggctggagaaggagtccgagcaggagcccctggtgagggcactggaggcgggaggctgcgcagtggtccgggacaactggcacgagcacatctccatgccgctgcagacagatctgagaaagttccggtcctataaggggacatcagtgcgagacctgctccgtgctgtgaggaacaagaagcaccactacagggagctcccagttgaggtgcgacaggcactcggccaagtccctgatggcttcgtccagtacttcacaaaccgcttcccacggctgctcctccacacgcaccgagccatgaggagctgcgcctctgagagcctcttcctgccctactacccaccagactcagaggccagggggccgtgccctggggctgcagggaggtgaagtgggccggaggccacacaaatggtctccatgctggctcactgaagagctgagcctgtggctggcctcagaatcaggctgggtgcagtggctcacacctgtaatcccagcattttgggaggctgaggtgggagaatcacttgagcccaggagttcgaggctgcagtgagccaggatcatgccactgcactccagcctggtccacagagagacactgtcaccccctttcccccacaagactggcagaggctgggcagcctggggctgatgaagcagagatgttcgctggatcccaggccctggcacccctcaggaaatacaagaaaaagaatattcacatctgtttaatgtgcataaagccaaggaaaggacagttccgaattcaataga

SEQ ID NO: 288144 - DNA, 2773 bp, Homo sapiens
gagatggctgggcctgtttgagggactctgaagcctcttctggctcctccggctgcccccgagtgcaggactgggcatcctgcctcatcacaaagagaatccacccacccaggaggacagcagtgaggctagctggaacaccacctaccgccgctactcagcgccccccatggatggctcacctgggaaatacatgagccacctggcgtcctgtgggatgggcctgctgctcactgtggacccagaaagtggggcagtgctgtggacacaagacctgggcatgcctgtgatgggcgtttacacctggcaccaggacggcctgcgccagctgccgcatctcaccctggctcgagacactctgcatttcctcgccctccgctggggccacatccgactgcctgcctcaggcccccaggacacagccaccctcttctctgccttggatacccagctgctgatgacactgtatgtagggaaggatgaaactggcttctatgtctctaaagcactggtccacacaggagtggccctggtgcctcgtggactgaccctggcccccgcagatggccccaccacagatgaggtgacactccaagtctcaggagagcgagagggctcacccagcactgctgttagatacccctcaggcagtgtggccctcccaagccagtggctgctcattggacaccacgagctacccccagtcctgcacaccaccatgctgagggtccatcccaccctggggagtggaactgcagagacaagacctccagagaatacccaggccccagccttcttcttggagctattgagcctgagccgagagaaactttgggactccgagctgcatccagaagaaaaaactccagactcttacttggggctgggaccccaagacctgctggcagctagcctcactgctgtcctcctgggagggtggattctctttgtgatgaggcagcaacagccgcaggtggtggagaagcagcaggagacccccctggcacctgcagactttgctcacatctcccaggatgcccagtccctgcactcgggggccacccggaggagccagaagaggcttcagagtccctcaaagcaagcccagccactcgacgaccctgaagctgagcaactcaccgtagtggggaagatttccttcaatcccaaggacgtgctgggccacggggcaggcgggactttcgttttccggggacagtttgagggacgggcagtggctgtcaagcggctcctccgcgagtgctttggcctggttcggcgggaagttcaactgctgcaggagtctgacaggcaccccaacgtgctccgctacttctgcaccgagcggggaccccagttccactacattgccctggagctctgccgggcctccttgcaggagtacgtagaaaacccggacctggatcgcgggggcctggagcccgaggtcgtgctgcagcagctgatgtctggcctggcccacctgcactctttacacatagtgcaccgggacctgaagccaggaaatattctcatcaccgggcctgacagccagggcctgggcagagtggtgctctcagacttcggcctctgcaagaagctgcctgctggccgctgtagcttcagcctccactccggcatccccggcacggaaggctggatggcgcccgagcttctgcagctcctgccaccagacagtcctaccagcgctgtggacatcttctctgcaggctgcgtgttctactacgtgctttctggtggcagccacccctttggagacagtctttatcgccaggcaaacatcctcacaggggttccctgtctggctcacctggaggaagaggtccacgacaaggtggttgcccgggacctggttggagccatgttgagcccactgccgcagccacgcccctctgccccccaggtgctggcccaccccttcttttggagcagagccaagcaactccagttcttccaggacgtcagtgactggctggagaaggagtccgagcaggagcccctggtgagggcactggaggcgggaggctgcgcagtggtccgggacaactggcacgagcacatctccatgccgctgcagacagatctgagaaagttccggtcctataaggggacatcagtgcgagacctgctccgtgctgtgaggaacaagaagcaccactacagggagctcccagttgaggtgcgacaggcactcggccaagtccctgatggcttcgtccagtacttcacaaaccgcttcccacggctgctcctccacacgcaccgagccatgaggagctgcgcctctgagagcctcttcctgccctactacccaccagactcagaggccagggggccgtgccctggggctgcagggaggtgaagtgggccggaggccacacaaatggtctccatgctggctcactgaagagctgagcctgtggctggcctcagaatcaggctgggtgcagtggctcacacctgtaatcccagcattttgggaggctgaggtgggagaatcacttgagcccaggagttcgaggctgcagtgagccaggatcatgccactgcactccagcctggtccacagagagacactgtcaccccctttcccccacaagactggcagaggctgggcagcctggggctgatgaagcagagatgttcgctggatcccaggccctggcacccctcaggaaatacaagaaaaagaatattcacatctgtttaatgtgcataaagccaaggaaaggacagttccgaattcaataga

SEQ ID NO: 288145 - DNA, 3056 bp, Homo sapiens
tgacactgggtgtgggaatttctgcatttcctcaagaggctgtgtagcaaaatgattcagtgtgctggctctggagcctgactgcctgggttcaaggccaggctctgccatttagtagctgtgtgacattagccaagttacatggcctctccaagccccagtttccttacctgaaaagtggaaatgatagtaatacctgttaattggttgctatggaaatgggctcacctggcacagtgagcactgtgtgttgctgctcttactccttcctgtaaattttccgtctcctagaaactgccattcaccatccctgagctggttcatgcttctccctgccgcagctctgatggggtcttctacacaggccggaagcaggatgcctggtttgtggtggaccctgagtcaggggagacccagatgacactgaccacagcgggtccctccaccccccgcctctacatcggccgaacacagtatacggtcaccatgcatgacccaagagccccagccctgcgctggaacaccacctaccgccgctactcagcgccccccatggatggctcacctgggaaatacatgagccacctggcgtcctgtgggatgggcctgctgctcactgtggacccagaaagtggggcagtgctgtggacacaagacctgggcatgcctgtgatgggcgtttacacctggcaccaggacggcctgcgccagctgccgcatctcaccctggctcgagacactctgcatttcctcgccctccgctggggccacatccgactgcctgcctcaggcccccaggacacagccaccctcttctctgccttggatacccagctgctgatgacactgtatgtagggaaggatgaaactggcttctatgtctctaaagcactggtccacacaggagtggccctggtgcctcgtggactgaccctggcccccgcagatggccccaccacagatgaggtgacactccaagtctcaggagagcgagagggctcacccagcactgctgttagatacccctcaggcagtgtggccctcccaagccagtggctgctcattggacaccacgagctacccccagtcctgcacaccaccatgctgagggtccatcccaccctggggagtggaactgcagagacaagacctccagagaatacccaggccccagccttcttcttggagctattgagcctgagccgagagaaactttgggactccgagctgcatccagaagaaaaaactccagactcttacttggggctgggaccccaagacctgctggcagctagcctcactgctgtcctcctgggagggtggattctctttgtgatgaggcagcaacagccgcaggtggtggagaagcagcaggagacccccctggcacctgcagactttgctcacatctcccaggatgcccagtccctgcactcgggggccacccggaggagccagaagaggcttcagagtccctcaaagcaagcccagccactcgacgaccctgaagctgagcaactcaccgtagtggggaagatttccttcaatcccaaggacgtgctgggccacggggcaggcgggactttcgttttccggggacagtttgagggacgggcagtggctgtcaagcggctcctccgcgagtgctttggcctggttcggcgggaagttcaactgctgcaggagtctgacaggcaccccaacgtgctccgctacttctgcaccgagcggggaccccagttccactacattgccctggagctctgccgggcctccttgcaggagtgcaccgggacctgaagccaggaaatattctcatcaccgggcctgacagccagggcctgggcagagtggtgctctcagacttcggcctctgcaagaagctgcctgctggccgctgtagcttcagcctccactccggcatccccggcacggaaggctggatggcgcccgagcttctgcagctcctgccaccagacagtcctaccagcgctgtggacatcttctctgcaggctgcgtgttctactacgtgctttctggtggcagccacccctttggagacagtctttatcgccaggcaaacatcctcacaggggttccctgtctggctcacctggaggaagaggtccacgacaaggtggttgcccgggacctggttggagccatgttgagcccactgccgcagccacgcccctctgccccccaggtgctggcccaccccttcttttggagcagagccaagcaactccagttcttccaggacgtcagtgactggctggagaaggagtccgagcaggagcccctggtgagggcactggaggcgggaggctgcgcagtggtccgggacaactggcacgagcacatctccatgccgctgcagacagatctgagaaagttccggtcctataaggggacatcagtgcgagacctgctccgtgctgtgaggaacaagaagcaccactacagggagctcccagttgaggtgcgacaggcactcggccaagtccctgatggcttcgtccagtacttcacaaaccgcttcccacggctgctcctccacacgcaccgagccatgaggagctgcgcctctgagagcctcttcctgccctactacccaccagactcagaggccagggggccgtgccctggggctgcagggaggtgaagtgggccggaggccacacaaatggtctccatgctggctcactgaagagctgagcctgtggctggcctcagaatcaggctgggtgcagtggctcacacctgtaatcccagcattttgggaggctgaggtgggagaatcacttgagcccaggagttcgaggctgcagtgagccaggatcatgccactgcactccagcctggtccacagagagacactgtcaccccctttcccccacaagactggcagaggctgggcagcctggggctgatgaagcagagatgttcgctggatcccaggccctggcacccctcaggaaatacaagaaaaagaatattcacatctgtttaatgtgcataaagccaaggaaaggacagttccgaattcaataga

SEQ ID NO: 288146 - DNA, 1526 bp, Homo sapiens
tgacactgggtgtgggaatttctgcatttcctcaagaggctgtgtagcaaaatgattcagtgtgctggctctggagcctgactgcctgggttcaaggccaggctctgccatttagtagctgtgtgacattagccaagttacatggcctctccaagccccagtttccttacctgaaaagtggaaatgatagtaatacctgttaattggttgctatggaaatgggctcacctggcacagtgagcactgtgtgttgctgctcttactccttcctgtaaattttccgtctcctagaaactgccattcaccatccctgagctggttcatgcttctccctgccgcagctctgatggggtcttctacacaggccggaagcaggatgcctggtttgtggtggaccctgagtcaggggagacccagatgacactgaccacagcgggtccctccaccccccgcctctacatcggccgaacacagtatacggtcaccatgcatgacccaagagccccagccctgcgctggaacaccacctaccgccgctactcagcgccccccatggatggctcacctgggaaatacatgagccacctggcgtcctgtgggatgggcctgctgctcactgtggacccagaaagtggggcagtgctgtggacacaagacctgggcatgcctgtgatgggcgtttacacctggcaccaggacggcctgcgccagctgccgcatctcaccctggctcgagacactctgcatttcctcgccctccgctggggccacatccgactgcctgcctcaggcccccaggacacagccaccctcttctctgccttggatacccagctgctgatgacactgtatgtagggaaggatgaaactggcttctatgtctctaaagcactggtccacacaggagtggccctggtgcctcgtggactgaccctggcccccgcagatggccccaccacagatgaggtgacactccaagtctcaggagagcgagagggctcacccagcactgctgttagatacccctcaggcagtgtggccctcccaagccagtggctgctcattggacaccacgagctacccccagtcctgcacaccaccatgctgagggtccatcccaccctggggagtggaactgcagagacaagacctccagagaatacccaggccccagccttcttcttggagctattgagcctgagccgagagaaactttgggactccgagctgcatccagaagaaaaaactccagactcttacttggggctgggaccccaagacctgctggcagctagcctcactgctgtcctcctgggagggtggattctctttgtgatgaggcagcaacagccgcaggtggtggagaagcagcaggagacccccctggcacctgcctggggctgatgaagcagagatgttcgctggatcccaggccctggcacccctcaggaaatacaagaaaaagaatattcacatctgtttaatgtgcataaagccaaggaaaggacagttccgaattcaataga

SEQ ID NO: 288147 - DNA, 1477 bp, Homo sapiens
tgacactgggtgtgggaatttctgcatttcctcaagaggctgtgtagcaaaatgattcagtgtgctggctctggagcctgactgcctgggttcaaggccaggctctgccatttagtagctgtgtgacattagccaagttacatggcctctccaagccccagtttccttacctgaaaagtggaaatgatagtaatacctgttaattggttgctatggaaatgggctcacctggcacagtgagcactgtgtgttgctgctcttactccttcctgtaaattttccgtctcctagaaactgccattcaccatccctgagctggttcatgcttctccctgccgcagctctgatggggtcttctacacaggccggaagcaggatgcctggtttgtggtggaccctgagtcaggggagacccagatgacactgaccacagcgggtccctccaccccccgcctctacatcggccgaacacagtatacggtcaccatgcatgacccaagagccccagccctgcgctggaacaccacctaccgccgctactcagcgccccccatggatggctcacctgggaaatacatgagccacctggcgtcctgtgggatgggcctgctgctcactgtggacccagaaagtggggcagtgctgtggacacaagacctgggcatgcctgtgatgggcgtttacacctggcaccaggacggcctgcgccagctgccgcatctcaccctggctcgagacactctgcatttcctcgccctccgctggggccacatccgactgcctgcctcaggcccccaggacacagccaccctcttctctgccttggatacccagctgctgatgacactgtatgtagggaaggatgaaactggcttctatgtctctaaagcactggtccacacaggagtggccctggtgcctcgtggactgaccctggcccccgcagatggccccaccacagatgaggtgacactccaagtctcaggagagcgagagggctcacccagcactgctgttagatacccctcaggcagtgtggccctcccaagccagtggctgctcattggacaccacgagctacccccagtcctgcacaccaccatgctgagggtccatcccaccctggggagtggaactgcagagacaagacctccagagaatacccaggccccagccttcttcttggagctattgagcctgagccgagagaaactttgggactccgagctgcatccagaagaaaaaactccagactcttacttggggctgggaccccaagacctgctggcagctagcctcactgctgtcctcctgggagggtggattctctttgtgatgaggcagcaacagccgcaggtggtggagaagcagcaggagacccccctggcacctgccctcaggaaatacaagaaaaagaatattcacatctgtttaatgtgcataaagccaaggaaaggacagttccgaattcaataga

SEQ ID NO: 288148 - DNA, 689 bp, Homo sapiens
tgacactgggtgtgggaatttctgcatttcctcaagaggctgtgtagcaaaatgattcagtgtgctggctctggagcctgactgcctgggttcaaggccaggctctgccatttagtagctgtgtgacattagccaagttacatggcctctccaagccccagtttccttacctgaaaagtggaaatgatagtaatacctgttaattggttgctatggaaatgggctcacctggcacagtgagcactgtgtgttgctgctcttactccttcctgtaaattttccgtctcctagaaactgccattcaccatccctgagctggttcatgcttctccctgccgcagctctgatggggtcttctacacaggccggaagcaggatgcctggtttgtggtggaccctgagtcaggggagacccagatgacactgaccacagcgggtccctccaccccccgcctctacatcggccgaacacagtatacggtcaccatgcatgacccaagagccccagccctgcgctggaacaccacctaccgccgctactcagcgccccccatggatggctcacctgggaaatgtgagttccacctttctctggtcccatcttggagcaaggtccccaacccagggaaccctgaacagcatccatgaccaattcccagccacatttcgacccacttgacctccccagg

SEQ ID NO: 288149 - DNA, 492 bp, Homo sapiens
ctgcgatcttgctctgtaagttcatgcagtctggtgaggccatctcagtcacagatactgggcccatcacggggcagggcgtggccaggacaaagctctcttaggctctcatgttacagcaacagccgcaggtggtggagaagcagcaggagacccccctggcacctgcagactttgctcacatctcccaggatgcccagtccctgcactcgggggccacccggaggagccagaagaggcttcagagtccctcaaagcaagcccagccactcgacgaccctgaaggtgagcctgtgtgaacaagacagggcagtcaggaacagagaaaagccaggggcagatttagctgcaaagctggtttattaaaagccactatagtggggtggttaggtctacatgaattaagaagagtgtattgagtagagcctgctacgtaattgagcactctaggagtgtctgctgtcattttttcatcattatatttttggagac

SEQ ID NO: 288150 - DNA, 395 bp, Homo sapiens
cgacacccatatgagccccacccggcttcaatccctgccttggcccagtgcctggagggtcctccttccctagctaagcgctgccctcacacaccacctcctccagaatggcaacagccctgtttgtgtgctgttactgcctaccaggcactgtgtaagagcatcagcctctttcatccccatggcaaccctctgagagagccacctttcaatgggagctttgctggtggaagagaaagacagagaagagcacctagcacagtgagaacgtggagaaggggcatggagggcggggcgggggcagggaaacactgattctcaccagaagcctctgagggaggcgttagtgccccacggagcaggtgaagaaatggaaactcaagggttaaatgaat

SEQ ID NO: 288151 - DNA, 751 bp, Homo sapiens
accatgttaagaagagccttttgcctcccaccatgattctgaggcctccccagccatgcagaactaatctgggagcactcagttgtggaacccagccaccatgttgtgaagaagccctgtgcagtggtccaagtgaccaggagtcaaagctcccagccaatagccagcactaacttgtcagcagtgtcatggagcccacttgaaagaggattctaattatgctgcccaagctgtggccacatggaggagagatatacagtccctgctgaaccctgctctaattacagggagacttgaaaaccagtggtggcgagactccaagactattatttttatttccggacaaaaacatctgcttcacacagtgcacggcatcaaatgaagaggaaagaacttgtatcccaaagcctggctttctgtatcatccacaaattaagacagcatctgctgagcccatgctgagcctgtcacagtcaacaactgggaaaccggggcctctactgaaccaggggacaagtagccgaagcacttaaacagcttgatacttgttttttggtacatttgtttatttaaagcacaggaaatgaataaaatgccacctaaaaagtatctgcaatgaataaattatttccagtgaagcactgcagatccacacacaccagtctgctaacctttaccaaggccatgtccggtgggcttgtgcttgttccagttgactcttccttgagacctttcccttctgtgcaatgac

SEQ ID NO: 288152 - DNA, 1147 bp, Homo sapiens
gtgccgcggctccgtttggttccgcttcgctggcgcccgccgggctcttcccccgccgaggcctgtggtttgtggagtcgaatttccctgccaccagtgcccggttagcaggggcgccagcctgggcgcctgcgcggacggcgggcgtcgtcaccatggcagcatccgctggaggcccaggatcttggagtgaaaatatactggaatattttctgagaaatagccagattacagcagaagacggtgctgagatcacctggtatcatgcagctaaccacaaggcacaaacaaatgaggcactgaaaaagacgagatttcaccgtgttggccagactggtctcgaactcctgacctcatgatccgcctgccttggcctcgcgaagtgctgggattacaggtgtgagccaccacgcccggccaagaactttacttttattaaggtactgctcacatgatagaggctgatgtccttcttccaagtgatggatcagaacacagccagccaattatggcccatccccctgaaacaaacagtgataatactctacaggagtggctgactgaagttatgaaaagcaataaaggcatcaagctggatttcaaaagtctggcagttgtagaaccatccatgatgctcttggaaaatgtgaagaggcatctgaagcgtcctgtatggattaatgccgatattcttcctggtccaaatggaaatagcaaagtaatagatgcaaaaccatttttagacaccgtgacatccttctttccagacgtgacgttttccctgggttggacaacaggatggcatcctgagaaagtcaatgaagggtacagttggacaatggtgaaagagatggaatatatatgtaatgaactaagtcagcctgtaacgttccctgtcagagcagcattagtcaggcagtcttgttctcagttactttggctgttaaagaaatcaaacaggtacagcctgactatttggactggaaaaaatgataactattccgttgaagatttactttacattagagaccattttgacaaaaaacaagttttctatgacatcttggaaccacaaaaccatgaatttaaacaagccattggaatcaaagttaatctctaagaagaagattctcaattatttcctgtg

SEQ ID NO: 288153 - DNA, 1094 bp, Homo sapiens
aaggaaatactataattttatattttacagtcatttttagaattgtttatgtatccaaactcacccaagaatacataagggaaagaagctacttttattctccagggtcatgagcctgaattagagatacagggcttggatccacttgggtatttcataaatgtgaatttacaggttattaagtgtatttcatttatcttatttatacattctggaacgagtgaatatttgtgtcttttaaaaaactgttttcacaccaagtgatcctaatatggagttttgaaacctctattttgtccacaagtagtaccactattcatatatttatagactctttaaggtatattcatgaataataagcacagttcaacatttagagatatggcatatgttagcttttccctctggtgctatgcgatctttgattttatttaacccagacattattgtattttgattatgaatttgagaacattgagaccactagtctaaaagaacttctttttactttacctaaagaatctatctcattgacaacaaattatgtttttagtctggcagttgtagaaccatccatgatgctcttggaaaatgtgaagaggcatctgaagcgtcctgtatggattaatgccgatattcttcctggtccaaatggaaatagcaaagtaatagatgcaaaaccatttttagacaccgtgacatccttctttccagacgtgacgttttccctgggttggacaacaggatggcatcctgagaaagtcaatgaagggtacagttggacaatggtgaaagagatggaatatatatgtaatgaactaagtcagcctgtaacgttccctgtcagagcagcattagtcaggcagtcttgttctcagttactttggctgttaaagaaatcaaacaggtacagcctgactatttggactggaaaaaatgataactattccgttgaagatttactttacattagagaccattttgacaaaaaacaagttttctatgacatcttggaaccacaaaaccatgaatttaaacaagccattggaatcaaagttaatctctaagaagaagattctcaattatttcctgtg

SEQ ID NO: 288154 - DNA, 556 bp, Homo sapiens
ccatgccactcatctggtttcttagtccatttaacagtcctgcaattcagatagagcagttatgtcgtttagacaacagcagtatgaatgtttttttgtctctagtccctcttgatgaaagaatgaaatatgaaagtacagttacaccattgctgattaattttttcatctgagtgcatttgagttagagataaatgaaagcatttttaggcttattggaatgactcatcgctttcttccacttttaactgtataattctgttttatttcaatgcaggtacagcctgactatttggactggaaaaaatgataactattccgttgaagatttactttacattagagaccattttgacaaaaaacaagttttctatgacatcttggaaccacaaaaccatgaatttaaacaagccattggaatcaaagttaatctctaagaagaagattctcaattatttcctgtgttttggtttcataatccttctctccattggtctgaattaattaccatataaattatggttattgattgacgttccaagtcatctaatcaaga

SEQ ID NO: 288155 - DNA, 1013 bp, Homo sapiens
gtgccgcggctccgtttggttccgcttcgctggcgcccgccgggctcttcccccgccgaggcctgtggtttgtggagtcgaatttccctgccaccagtgcccggttagcaggggcgccagcctgggcgcctgcgcggacggcgggcgtcgtcaccatggcagcatccgctggaggcccaggatcttggagtgaaaatatactggaatattttctgagaaatagccagattacagcagaagacggtgctgagatcacctggtatcatgcagctaaccacaaggcacaaacaaatgaggcactgaaaagtactgctcacatgatagaggctgatgtccttcttccaagtgatggatcagaacacagccagccaattatggcccatccccctgaaacaaacagtgataatactctacaggagtggctgactgaagttatgaaaagcaataaaggcatcaagctggatttcaaaagtctggcagttgtagaaccatccatgatgctcttggaaaatgtgaagaggcatctgaagcgtcctgtatggattaatgccgatattcttcctggtccaaatggaaatagcaaagtaatagatgcaaaaccatttttagacaccgtgacatccttctttccagacgtgacgttttccctgggttggacaacaggatggcatcctgagaaagtcaatgaagggtacagttggacaatggtgaaagagatggaatatatatgtaatgaactaagtcagcctgtaacgttccctgtcagagcagcattagtcaggcagtcttgttctcagttactttggctgttaaagaaatcaaacaggtacagcctgactatttggactggaaaaaatgataactattccgttgaagatttactttacattagagaccattttgacaaaaaacaagttttctatgacatcttggaaccacaaaaccatgaatttaaacaagccattggaatcaaagttaatctctaagaagaagattctcaattatttcctgtg

SEQ ID NO: 288156 - DNA, 309 bp, Homo sapiens
ccggacggatgtatgccaacacccttctcctcctgtctggtctcatcgtagagtctagaagagcaaacattcacttgcagcctccctgtaccaaggagtggccatgaggcaattctgcccaatgaatcagaagaggaatgtgttggggataacatcacgtgatgttatcgcccaacaccatggtaaggaaacagacccttacttacctccatgtcttatttttagagttaagtaatgaggattctaatcatgtcaaactagcaaattctacctgtactgcaaatcttaagagttgagggtatttaatga

SEQ ID NO: 288157 - DNA, 409 bp, Homo sapiens
gcccgttggtgtgcggcacgctgcggtccgtacccggcccggggcccgcgcccgcgcccgggtggaagcgggccttggcgtagttgctcacgaactggtcctgcaggaaagagccggccatggcgtagcgggccccgggcacgatctgcgagcgcggcgagtcgttgggcgagggggtcaggcggtccatgtcacagccggtgtagatcctgcgggattgtttcagaaacccctaggaaaaagccgcgcacgcagtaatcatgaaagactggccttcacccgtgttctggaacccgaggtttgctgctggaagcctccaaagtacttagtgtctattgtttcccctgtgtgaaactttcactcccacctctactaatacaaacaagaattactactctgaaaaagtagt

SEQ ID NO: 288158 - DNA, 410 bp, Homo sapiens
gcaagatacagaccatcaagggaacgacttccctcttctcttgctctctctcgtcaagtgtactggggtactgagagaggggcacaagcaaggactttcatcccacttctccaacatatgtgtgcacattaaggcagatttacctagggagtaagatgctctttgcccagtgggcctttcctctgcggtcagtttatgagtgaaatttctaagcaagattgtttcagaaacccctaggaaaaagccgcgcacgcagtaatcatgaaagactggccttcacccgtgttctggaacccgaggtttgctgctggaagcctccaaagtacttagtgtctattgtttcccctgtgtgaaactttcactcccacctctactaatacaaacaagaattactactctgaaaaagtagt

SEQ ID NO: 288159 - DNA, 304 bp, Homo sapiens
aagtgggctctggacacttggatatctcaagaaaggaggaggtgggggatcctcagagggaataaaaaaggtttgtcctgttttaactctgttcccttaagaatttaacatttggacccaggtcgtcttacttcaaagctcatcactttagctagtaggctgtgggcaaattgaacctatctaatcatgaatatggtgataatttaggtcccacatctccagtgatgctgccttacaagagtgttgtgagggtatgaactataaggtactctaccaatgcaagttattgtcaccccaggttcac

SEQ ID NO: 288160 - DNA, 1045 bp, Homo sapiens
catacttagttcaataaatcagagaaacttttttcttatgaatgagaggtacactaatggctttttcataaggacagtgtataaggatgtcctgggtcaggatgagaacatacctaaaaggcacacaggggtttgtaaagtaggagagtataagaccgtctttagatttgccaagactctcagggtgatagcttagttgtagcctaagttcataaatagtcatcatgtactagcaactgtccaaggctctggcatgtaaagattattgctattaatttcctcttactcaagacacttactttgtagtgagcaaaattagagttgttaacatgtgggtagggcttgctagaaatgaaagaccctcacaaggattacctcattaaataactgtgaaatctgaaatctaaactctgtgatattggaaggatattttaaaataaagggactgacctgccagttcaagcttagctctggcttctttgtctttggcaataaatctgtattcaccctggtcacggggcttaatatcacaaatctgtagtcgatgtatctttccttcactcatcatctggtgtttatcaccctggacaacaaccatgttatttcttagccattggacttccaccttatctttattgagttctgctaaaaagacaacatcagcaccaggggcttcaagaatatcttgtggaggcctgatgatctcaacaggaatttctggaaagaaaatgtgaaataaatacaaatatgtttacattttgattaacaattttaaaaaattggtaacattagaattgttttttcacttaatatgtaccttccacaaaaagtctagcacgagacttcctgtcttctaccccgcaagcatattcacactcatcatccagcctgcaatcttttataatgagtctgtgtatacttccatctttttcaaatttgtatctaaaggagacattggattatcagttagcttgcaatgatggccactaaattgtcaaaagtgtatatatagctacagaaatagagaataaaaagatcttgctta

SEQ ID NO: 288161 - DNA, 896 bp, Homo sapiens
ccttcctcaagacctgtcacttccattctgtcagaaaacagaataggatgttttactgtgatgtcgataatcgtttcattgtgtagtactcataatctttcaaaaattcaaacccctggtataatactagtctttaaattaaacctggattacttcaacactataactgaatacattttcatttcaatactgtcatgaaaaccctgagcaggcagtacattcagcagcacctttaaaaatcagacagatacaccggcagcataggattctcaatgaaaaaagacaaacatttaaattttccccaacaaagcccattttagtgactaggagtacacatttactctcatgccaaattaaaaacctactttgtttctgcaacaggttctccacaggcaacccatttatcagaaccacgtggacatctttcaactatcctggacaacaaccatgttatttcttagccattggacttccaccttatctttattgagttctgctaaaaagacaacatcagcaccaggggcttcaagaatatcttgtggaggcctgatgatctcaacaggaatttctggaaagaaaatgtgaaataaatacaaatatgtttacattttgattaacaattttaaaaaattggtaacattagaattgttttttcacttaatatgtaccttccacaaaaagtctagcacgagacttcctgtcttctaccccgcaagcatattcacactcatcatccagcctgcaatcttttataatgagtctgtgtatacttccatctttttcaaatttgtatctaaaggagacattggattatcagttagcttgcaatgatggccactaaattgtcaaaagtgtatatatagctacagaaatagagaataaaaagatcttgctta

SEQ ID NO: 288162 - DNA, 795 bp, Homo sapiens
atatatgtgccagtgtcacttctcttactatcaacaatagtcactgtggatttcttagggacattttcaatggtaattcttttgtcctgcttcagaatcatatcagcctttgtccaagttattttaggttcaggttttccggttacggtggcaggaagttcaatcttggtcccagcttttacagtgagaccagcaaggagcttcacatcgaggaagatttctggggcctctgaattggaaaagattatttatgatgttatcaagttcaagcagatttaaggttctccacaggcaacccatttatcagaaccacgtggacatctttcaactatcctggacaacaaccatgttatttcttagccattggacttccaccttatctttattgagttctgctaaaaagacaacatcagcaccaggggcttcaagaatatcttgtggaggcctgatgatctcaacaggaatttctggaaagaaaatgtgaaataaatacaaatatgtttacattttgattaacaattttaaaaaattggtaacattagaattgttttttcacttaatatgtaccttccacaaaaagtctagcacgagacttcctgtcttctaccccgcaagcatattcacactcatcatccagcctgcaatcttttataatgagtctgtgtatacttccatctttttcaaatttgtatctaaaggagacattggattatcagttagcttgcaatgatggccactaaattgtcaaaagtgtatatatagctacagaaatagagaataaaaagatcttgctta

SEQ ID NO: 288163 - DNA, 553 bp, Homo sapiens
aaacttcccacccacttcttgcaggaggctgtgtggttactccctagtagtatggtatactctgaggctaaaataaaacaaaccctgtcaacagactaggcctttttgatcagtcagaaatgctcagtactacagaagcggacctcatctctatactaactgagttgtttccgtaaaactgatcctgtctcctggagatggctagcatccagtcccccagtgcagaagaaagaagctcagtttcccaaatgggcaaggaccgctactggtagacagatagggaatagatgggttggaagaaaggagaagagcagaacagagtcaagtgtcagcgtttgagctattccagggtgaacccagcaatctcaggtttggtcttttgaagcaaaccaagatccccaggaaactgtggcatgttcacgtacttgccattgaacacagagttgttgatccaacgccaccttttctcttcacgatggtaaattaagccaataaaatacttctcagcatcagttatgtcctgaagaaacttctggaataaaaaaaaaatttt

SEQ ID NO: 288164 - DNA, 1150 bp, Homo sapiens
tattctttcttccgttctgtttagtttttttgtttgttgctcgtgttgtgtgtggcgtcgcttctagctgtcgtttctgttttgtgtgtgttttgttgcttcgtgccgtctgtctgtttgttcttgtctttctcttgctttttgttttagtgtgcctgttttcttttgcctatgctcttgctttgttctgttgggtcatctgtctggtgtttgtttgtttgtgtgtctgtcgctggcgttgcgtgctgcttttgtttgttctttgttcccattctgttgttcgtctctacttctcgttcttgttcttgtcgtgtgttgtcattgcttgtgcttgtcctttcgttgtgttttgtctgcctctcttctttggttgtttttgtctggtttgtgcgtcttgcgtcttgtggttagggtatgccgtggccgtgtcgctgcgcggtcgggtgtacctttctggtgcgccgccgcccccctccttttctttttttttttttctttttttcttttctctttctttttttttttttttttttttttttttttttttttttttttttttttttttttttttttttttttttttttttttttttgtgagaacctgaattaaatttttaatattttaaaaaaggaaagttgctgggaagctggtaaacagaaacagaagattagaggcctaactagaaagagacactggtgttagcagagagatattgaggggctgtaagcctaaggtttgaaatctaaagatagagtggaaaagggagtaggcacccccaccagcccctgcttgacatctgctttagttcattccagcaggaaggaggagaagggcagggaggtagggagcttctcagcaaagccagcttcagctttgataatctcacccacctaccccatttaaggagttccaggtttaagagtttaaaaacaggtggcacccagaccatcattcaggagacaggaactcattccaggttcctagagaactcctatctcagacctgagggtttccagggcttcagctgagctcctctggctaaccagtagtcacttgatcagtcctgctgccttgaccccatctccaggaggggctatggccagagggagtagagggagtccagcccccaagccttgtgaggcactgtta

SEQ ID NO: 288165 - DNA, 4945 bp, Homo sapiens
ctggataaaaggccttagaaccagttagtgatctgcctacacctgaatccctgaaacatctgaactgttttgtaaatcatcttatccccaacctcagtaccaccggatcttcacttctcagtgggattttgtcctttgcatgaccctactttcagcagggctttgaggctgggaaactgatctgctgggtgactttcattccagttgctgggacggaaggctgaatgtagggtcattttgtatgggatatgcagagctctgggtttttttgttttttgttttttgagacggagtctcgctctgtcgccaggctggagtgcagtggtgcgatctcggctcactgcaacctccgcctcccggttcaagccattcttctgcctcagcctcagcgagtagctgagactaccggcgcacgccaccacgcccagctaattgttttgtatttttagtagagacggggtttcaccatgttggccaggatggtctcgatctcttgacctcgtgatctgcccgcctcggcctcccaaagtgccgagattacaggtgtgagccaccgcgctcggccagagctctgggttttaatcctactttagctgtagaaccttgggcaaataacttcatctttttgggtcctaattttcctcctgtctaactggagggactgtgatccttccaccttggatggaagaggcttacctgacagccagcctgcctgctgggagccaggagagtcagctcattaaatcttgaagaaccgctgtatgccctttttccttctaagtcatgtctgctgcctgtgagcctgggaaggagtgctttcaaaacctgtatttttgccctctttagtaaatttagaactgtagaggctaataaactgcgatgagacatttaaaagctctgctccaaagaagtgaacgactctttcaccaccccttgcatcccaaaccttcggttctggcagagttcttgccgcagaggttccttaggagcaccccgcgcggcccgcgcgagcgcgcatgcgcgtcgaaccccacccccttgccggcgggcctcggttcaaacgacccggtgggtctacagcggaagggagggagcgaaggtaggaggcagggcttgcctcactggccaccctcccaaccccaagagcccagccccatggtccccgccgccggcgcgctgctgtgggtcctgctgctgaatctgggtccccgggcggcgggggcccaaggcctgacccagactccgaccgaaatgcagcgggtcagtttacgctttgggggccccatgacccgcagctaccggagcaccgcccggactggtcttccccggaagacaaggataatcctagaggacgagaatgatgccatggccgacgccgaccgcctggctggaccagcggctgccgagctcttggccgccacggtgtccaccggctttagccggtcgtccgccattaacgaggaggatgggtcttcagaagagggggttgtgattaatgccggaaaggatagcaccagcagagagcttcccagtgcgactcccaatacagcggggagttccagcacgaggtttatagccaatagtcaggagcctgaaatcaggctgacttcaagcctgccgcgctcccccgggaggtctactgaggacctgccaggctcgcaggccaccctgagccagtggtccacacctgggtctaccccgagccggtggccgtcaccctcacccacagccatgccatctcctgaggatctgcggctggtgctgatgccctggggcccgtggcactgccactgcaagtcgggcaccatgagccggagccggtctgggaagctgcacggcctttccgggcgccttcgagttggggcgctgagccagctccgcacggagcacaagccttgcacctatcaacaatgtccctgcaaccgacttcgggaagagtgccccctggacacaagtctctgtactgacaccaactgtgcctctcagagcaccaccagtaccaggaccaccactacccccttccccaccatccacctcagaagcagtcccagcctgccacccgccagcccctgcccagccctggctttttggaaacgggtcaggattggcctggaggatatttggaatagcctctcttcagtgttcacagagatgcaaccaatagacagaaaccagaggtaatggccacttcatccacatgaggagatgtcagtatctcaacctctcttgccctttcaatcctagcacccactagatatttttagtacagaaaaacaaaactggaaaacacattgtttggtcttgtgtttctttacagaggtacctgagggaggagagacataaatcccttcatccctaagactgaactatgtaactagcagcctctggcttgttttctactccctgtccctcaggataaaatgttgatattgctcattttcctcatttccaacattgttttaaaacaagtacttcttttacaggcttgaaaaatctcaaataaacgctaagaaaagggagtaggaagaacaaggagttgagcccttgaaagatgacagtggtcttcttgccttcatgcttggccctctctcctcaaaagggcaatgttggtacaaaattccatctcagccactttcgaggagttatcttcattagctatatccatcctttaatccaacacacacctgcaatgattactgtgcaactattttgcttaattttttatttgaaaaaatgtatttaaaagtccaacaactttttaatataaattacgactctcaaacccattcccatcactttattagtgatggtagcatacatattagagaaggtagctaaaggcaagagagcaccaaaggaaaaagactgtccaaagaacaggtattagaatgaggccgaagatcacggtgaccagagatttctaggagtctctaacctttccaccctatcctgttaaccctttagatctctagtataacactcaggctactgaggtattttagagcaacaagctgggttactttcagagcaaccagcttgactggaactgagagtaaattgggaatgtatgaccaatcttagaccctgaaaaatggcagaaaatacatggaaatttgaaaaaaaaaaaaaaaaaaaaaaaaaaaaaaaagaacctcagtcactgttctgtagggataagcaaactgaatgggtggtggaattggcagaatggataccagttcctacattcctgaccccactaccataaaacaggatgtttcctgttgcaaagctaatgagaccccacccttcttgtctcagagcaggcaggagctcatctgtcttgttctgccttcctaattaccctggaagggccagaacgaagaacacctgagaatactgaaagtgcctaaaaacccctgctcctacgttgttttcccatttaaagcagactcttcagccagggggcagtgggacctggtcttcagacaaaactccctgagtctaatgtgtgtctaggactagggcacagaaatagagcttaaaatttggggaggataaggagtgtatctactgcttctctctcccctttccccaatcctaccataccctgttcatatctctacactgcaggaaccacttctccagagggcaagaatggaggagggggacctgtccatcatagcaacatgcaaacacaagcaaaacactgaataaagaattgtttggagattatgtgcagccctactgagcctcatttatatgggctcctagttgatccatggctcgggcttaagatgagtaagatgatgagggtagcgtgccaagcagaaatcacttcagagaaaaatatcttgactttagagttgtggttctcaaatggaggcgattttgccccctaggagaaatctggcaatgtatagagacatttttggttgtcataactagagtgggccaggggtgctgctaaatatcctgtaatgcacaaaataggaaacaggttttccttacaaagaacacttcagcccaaaatgtcaaaggcatctcggttgtgaaaccttgttctagagcctctccctgctcccgtgctgtgaggatcttaagactcctaaactcacagatgattgttttcaacctatttatctcaccatcctcaatgatcagaagtccaccttgagatggacttactcctagttctgccgcattctgggtttctttccagacccctcttcctcctctcacctgggccagcagggaggttggcagagggcaggaaagatgccccaaaacttaaatggaatgtcatcaggtgaagagctacctcttaccttaactcttattcggtgggaaacaaggttcctaatagggatagagttaagggcggaggcaacagcaggatgaggataattaagagaacctgaattaaatttttaatattttaaaaaaggaaagttgctgggaagctggtaaacagaaacagaagattagaggcctaactagaaagagacactggtgttagcagagagatattgaggggctgtaagcctaaggtttgaaatctaaagatagagtggaaaagggagtaggcacccccaccagcccctgcttgacatctgctttagttcattccagcaggaaggaggagaagggcagggaggtagggagcttctcagcaaagccagcttcagctttgataatctcacccacctaccccatttaaggagttccaggtttaagagtttaaaaacaggtggcacccagaccatcattcaggagacaggaactcattccaggttcctagagaactcctatctcagacctgagggtttccagggcttcagctgagctcctctggctaaccagtagtcacttgatcagtcctgctgccttgaccccatctccaggaggggctatggccagagggagtagagggagtccagcccccaagccttgtgaggcactgtta

SEQ ID NO: 288166 - DNA, 3166 bp, Homo sapiens
ctggataaaaggccttagaaccagttagtgatctgcctacacctgaatccctgaaacatctgaactgttttgtaaatcatcttatccccaacctcagtaccaccggatcttcacttctcagtgggattttgtcctttgcatgaccctactttcagcagggctttgaggctgggaaactgatctgctgggtgactttcattccagttgctgggacggaaggctgaatgtagggtcattttgtatgggatatgcagagctctgggtttttttgttttttgttttttgagacggagtctcgctctgtcgccaggctggagtgcagtggtgcgatctcggctcactgcaacctccgcctcccggttcaagccattcttctgcctcagcctcagcgagtagctgagactaccggcgcacgccaccacgcccagctaattgttttgtatttttagtagagacggggtttcaccatgttggccaggatggtctcgatctcttgacctcgtgatctgcccgcctcggcctcccaaagtgccgagattacaggtgtgagccaccgcgctcggccagagctctgggttttaatcctactttagctgtagaaccttgggcaaataacttcatctttttgggtcctaattttcctcctgtctaactggagggactgtgatccttccaccttggatggaagaggcttacctgacagccagcctgcctgctgggagccaggagagtcagctcattaaatcttgaagaaccgctgtatgccctttttccttctaagtcatgtctgctgcctgtgagcctgggaaggagtgctttcaaaacctgtatttttgccctctttagtaaatttagaactgtagaggctaataaactgcgatgagacatttaaaagctctgctccaaagaagtgaacgactctttcaccaccccttgcatcccaaaccttcggttctggcagagttcttgccgcagaggttccttaggagcaccccgcgcggcccgcgcgagcgcgcatgcgcgtcgaaccccacccccttgccggcgggcctcggttcaaacgacccggtgggtctacagcggaagggagggagcgaaggtaggaggcagggcttgcctcactggccaccctcccaaccccaagagcccagccccatggtccccgccgccggcgcgctgctgtgggtcctgctgctgaatctgggtccccgggcggcgggggcccaaggcctgacccagactccgaccgaaatgcagcgggtcagtttacgctttgggggccccatgacccgcagctaccggagcaccgcccggactggtcttccccggaagacaaggataatcctagaggacgagaatgatgccatggccgacgccgaccgcctggctggaccagcggctgccgagctcttggccgccacggtgtccaccggctttagccggtcgtccgccattaacgaggaggatgggtcttcagaagagggggttgtgattaatgccggaaaggatagcaccagcagagagcttcccagtgcgactcccaatacagcggggagttccagcacgaggtttatagccaatagtcaggagcctgaaatcaggctgacttcaagcctgccgcgctcccccgggaggtctactgaggacctgccaggctcgcaggccaccctgagccagtggtccacacctgggtctaccccgagccggtggccgtcaccctcacccacagccatgccatctcctgaggatctgcggctggtgctgatgccctggggcccgtggcactgccactgcaagtcgggcaccatgagccggagccggtctgggaagctgcacggcctttccgggcgccttcgagttggggcgctgagccagctccgcacggagcacaagccttgcacctatcaacaatgtccctgcaaccgacttcgggaagagtgccccctggacacaagtctctgtactgacaccaactgtgcctctcagagcaccaccagtaccaggaccaccactacccccttccccaccatccacctcagaagcagtcccagcctgccacccgccagcccctgcccagccctggctttttggaaacgggtcaggattggcctggaggatatttggaatagcctctcttcagtgttcacagagatgcaaccaatagacagaaaccagaggtaatggccacttcatccacatgaggagatgtcagtatctcaacctctcttgccctttcaatcctagcacccactagatatttttagtacagaaaaacaaaactggaaaacacattgtttggtcttgtgtttctttacagaggtacctgagggaggagagacataaatcccttcatccctaagactgaactatgtaactagcagcctctggcttgttttctactccctgtccctcaggataaaatgttgatattgctcattttcctcatttccaacattgttttaaaacaagtacttcttttacaggcttgaaaaatctcaaataaacgctaagaaaagggagtaggaagaacaaggagttgagcccttgaaagatgacagtggtcttcttgccttcatgcttggccctctctcctcaaaagggcaatgttggtacaaaattccatctcagccactttcgaggagttatcttcattagctatatccatcctttaatccaacacacacctgcaatgattactgtgcaactattttgcttaattttttatttgaaaaaatgtatttaaaagtccaacaactttttaatataaattacgactctcaaacccattcccatcactttattagtgatggtagcatacatattagagaaggtagctaaaggcaagagagcaccaaaggaaaaagactgtccaaagaacaggtattagaatgaggccgaagatcacggtgaccagagatttctaggagtctctaacctttccaccctatcctgttaaccctttagatctctagtataacactcaggctactgaggtattttagagcaacaagctgggttactttcagagcaaccagcttgactggaactgagagtaaattgggaatgtatgaccaatcttagaccctgaaaaatggcagaaaatacatgtccccgtacatcgttagaagcttgaattcgagcagtagtagtagtagtaggcggccgc

SEQ ID NO: 288167 - DNA, 3927 bp, Homo sapiens
agaagagacagcattttaccatgttggccaggctggtctagaactcctgacctcaagtgatccacccgcctcggcctcccaaagtgctgggattataggcatgagccaccatgcctggtcttggaaattctctgtttttttcacagacaagatctcgctatgttgcccaggctggtcttaaactcctgggctcaagcaattctcctgcctcagccttccaaagtgctgggattacaggcatgagctactgtgcccctgaccataagacttttttttcgagacagggtctctcatcactcaggctggagtgtggtggcgcagtcacaactcactgcaccctccatcttctgggctcaagcaatcctcccaccttagcctgctgaatagctgggactacagacgtgcaccaccatgcctggctaacaagatctcgctatgttgcccaggctggtctccaactcctgagctcaaggatctgcccaccttggccttccagaattctgggattacagacatgagccactgtgcccggcccataaagtctttttgatgcacagataattaacagatatgaaggatcttaatcaattaatagttttgacctaatacagcttaacagcaacaagtgccaaaatttgaggtcttactatgtgcactttacctgaatcgatcctcacatcctatgaggtattattatccctgcttttcagatgaagaaactgaggtttacaaagctagtaagtggcagagccacgagatttaaaccaggtttgacaccagtgcccactctcttcaccactaccatttgggagtactgtccttccaggacaaggaaggatagtcctctgcttttcccagaattagcaaaggttctgattgacttgataaggtagtctcaattgatacggatgataggactttgaggagggaaaggtaataaagcttacacttggtcattttgcttgtttctgtttttctccttgtgtgtccaataccattattgcatacaaaaataagtaaggggtgggcagtagggttgagggaatatgggtttgtgggagggggagatgaagcaaggaagggaaaagaatatagatgtggttgtaatttccctttttctctattttttttttcttacgcagatagacagaaaccagaggtaatggccacttcatccacatgaggagatgtcagtatctcaacctctcttgccctttcaatcctagcacccactagatatttttagtacagaaaaacaaaactggaaaacacattgtttggtcttgtgtttctttacagaggtacctgagggaggagagacataaatcccttcatccctaagactgaactatgtaactagcagcctctggcttgttttctactccctgtccctcaggataaaatgttgatattgctcattttcctcatttccaacattgttttaaaacaagtacttcttttacaggcttgaaaaatctcaaataaacgctaagaaaagggagtaggaagaacaaggagttgagcccttgaaagatgacagtggtcttcttgccttcatgcttggccctctctcctcaaaagggcaatgttggtacaaaattccatctcagccactttcgaggagttatcttcattagctatatccatcctttaatccaacacacacctgcaatgattactgtgcaactattttgcttaattttttatttgaaaaaatgtatttaaaagtccaacaactttttaatataaattacgactctcaaacccattcccatcactttattagtgatggtagcatacatattagagaaggtagctaaaggcaagagagcaccaaaggaaaaagactgtccaaagaacaggtattagaatgaggccgaagatcacggtgaccagagatttctaggagtctctaacctttccaccctatcctgttaaccctttagatctctagtataacactcaggctactgaggtattttagagcaacaagctgggttactttcagagcaaccagcttgactggaactgagagtaaattgggaatgtatgaccaatcttagaccctgaaaaatggcagaaaatacatggaaatttgaaaaaaaaaaaaaaaaaaaaaaaaaaaaaaaagaacctcagtcactgttctgtagggataagcaaactgaatgggtggtggaattggcagaatggataccagttcctacattcctgaccccactaccataaaacaggatgtttcctgttgcaaagctaatgagaccccacccttcttgtctcagagcaggcaggagctcatctgtcttgttctgccttcctaattaccctggaagggccagaacgaagaacacctgagaatactgaaagtgcctaaaaacccctgctcctacgttgttttcccatttaaagcagactcttcagccagggggcagtgggacctggtcttcagacaaaactccctgagtctaatgtgtgtctaggactagggcacagaaatagagcttaaaatttggggaggataaggagtgtatctactgcttctctctcccctttccccaatcctaccataccctgttcatatctctacactgcaggaaccacttctccagagggcaagaatggaggagggggacctgtccatcatagcaacatgcaaacacaagcaaaacactgaataaagaattgtttggagattatgtgcagccctactgagcctcatttatatgggctcctagttgatccatggctcgggcttaagatgagtaagatgatgagggtagcgtgccaagcagaaatcacttcagagaaaaatatcttgactttagagttgtggttctcaaatggaggcgattttgccccctaggagaaatctggcaatgtatagagacatttttggttgtcataactagagtgggccaggggtgctgctaaatatcctgtaatgcacaaaataggaaacaggttttccttacaaagaacacttcagcccaaaatgtcaaaggcatctcggttgtgaaaccttgttctagagcctctccctgctcccgtgctgtgaggatcttaagactcctaaactcacagatgattgttttcaacctatttatctcaccatcctcaatgatcagaagtccaccttgagatggacttactcctagttctgccgcattctgggtttctttccagacccctcttcctcctctcacctgggccagcagggaggttggcagagggcaggaaagatgccccaaaacttaaatggaatgtcatcaggtgaagagctacctcttaccttaactcttattcggtgggaaacaaggttcctaatagggatagagttaagggcggaggcaacagcaggatgaggataattaagagaacctgaattaaatttttaatattttaaaaaaggaaagttgctgggaagctggtaaacagaaacagaagattagaggcctaactagaaagagacactggtgttagcagagagatattgaggggctgtaagcctaaggtttgaaatctaaagatagagtggaaaagggagtaggcacccccaccagcccctgcttgacatctgctttagttcattccagcaggaaggaggagaagggcagggaggtagggagcttctcagcaaagccagcttcagctttgataatctcacccacctaccccatttaaggagttccaggtttaagagtttaaaaacaggtggcacccagaccatcattcaggagacaggaactcattccaggttcctagagaactcctatctcagacctgagggtttccagggcttcagctgagctcctctggctaaccagtagtcacttgatcagtcctgctgccttgaccccatctccaggaggggctatggccagagggagtagagggagtccagcccccaagccttgtgaggcactgtta

SEQ ID NO: 288168 - DNA, 2958 bp, Homo sapiens
aattcggcacgaggagtgggagggggccctagttaataacttcagtgtttcaaagcagtcccagcctgccacccgccagcccctgcccagccctggctttttggaaacgggtcaggattggcctggaggatatttggaatagcctctcttcagtgttcacagagatgcaaccaatagacagaaaccagaggtaatggccacttcatccacatgaggagatgtcagtatctcaacctctcttgccctttcaatcctagcacccactagatatttttagtacagaaaaacaaaactggaaaacacattgtttggtcttgtgtttctttacagaggtacctgagggaggagagacataaatcccttcatccctaagactgaactatgtaactagcagcctctggcttgttttctactccctgtccctcaggataaaatgttgatattgctcattttcctcatttccaacattgttttaaaacaagtacttcttttacaggcttgaaaaatctcaaataaacgctaagaaaagggagtaggaagaacaaggagttgagcccttgaaagatgacagtggtcttcttgccttcatgcttggccctctctcctcaaaagggcaatgttggtacaaaattccatctcagccactttcgaggagttatcttcattagctatatccatcctttaatccaacacacacctgcaatgattactgtgcaactattttgcttaattttttatttgaaaaaatgtatttaaaagtccaacaactttttaatataaattacgactctcaaacccattcccatcactttattagtgatggtagcatacatattagagaaggtagctaaaggcaagagagcaccaaaggaaaaagactgtccaaagaacaggtattagaatgaggccgaagatcacggtgaccagagatttctaggagtctctaacctttccaccctatcctgttaaccctttagatctctagtataacactcaggctactgaggtattttagagcaacaagctgggttactttcagagcaaccagcttgactggaactgagagtaaattgggaatgtatgaccaatcttagaccctgaaaaatggcagaaaatacatggaaatttgaaaaaaaaaaaaaaaaaaaaaaaaaaaaaaaagaacctcagtcactgttctgtagggataagcaaactgaatgggtggtggaattggcagaatggataccagttcctacattcctgaccccactaccataaaacaggatgtttcctgttgcaaagctaatgagaccccacccttcttgtctcagagcaggcaggagctcatctgtcttgttctgccttcctaattaccctggaagggccagaacgaagaacacctgagaatactgaaagtgcctaaaaacccctgctcctacgttgttttcccatttaaagcagactcttcagccagggggcagtgggacctggtcttcagacaaaactccctgagtctaatgtgtgtctaggactagggcacagaaatagagcttaaaatttggggaggataaggagtgtatctactgcttctctctcccctttccccaatcctaccataccctgttcatatctctacactgcaggaaccacttctccagagggcaagaatggaggagggggacctgtccatcatagcaacatgcaaacacaagcaaaacactgaataaagaattgtttggagattatgtgcagccctactgagcctcatttatatgggctcctagttgatccatggctcgggcttaagatgagtaagatgatgagggtagcgtgccaagcagaaatcacttcagagaaaaatatcttgactttagagttgtggttctcaaatggaggcgattttgccccctaggagaaatctggcaatgtatagagacatttttggttgtcataactagagtgggccaggggtgctgctaaatatcctgtaatgcacaaaataggaaacaggttttccttacaaagaacacttcagcccaaaatgtcaaaggcatctcggttgtgaaaccttgttctagagcctctccctgctcccgtgctgtgaggatcttaagactcctaaactcacagatgattgttttcaacctatttatctcaccatcctcaatgatcagaagtccaccttgagatggacttactcctagttctgccgcattctgggtttctttccagacccctcttcctcctctcacctgggccagcagggaggttggcagagggcaggaaagatgccccaaaacttaaatggaatgtcatcaggtgaagagctacctcttaccttaactcttattcggtgggaaacaaggttcctaatagggatagagttaagggcggaggcaacagcaggatgaggataattaagagaacctgaattaaatttttaatattttaaaaaaggaaagttgctgggaagctggtaaacagaaacagaagattagaggcctaactagaaagagacactggtgttagcagagagatattgaggggctgtaagcctaaggtttgaaatctaaagatagagtggaaaagggagtaggcacccccaccagcccctgcttgacatctgctttagttcattccagcaggaaggaggagaagggcagggaggtagggagcttctcagcaaagccagcttcagctttgataatctcacccacctaccccatttaaggagttccaggtttaagagtttaaaaacaggtggcacccagaccatcattcaggagacaggaactcattccaggttcctagagaactcctatctcagacctgagggtttccagggcttcagctgagctcctctggctaaccagtagtcacttgatcagtcctgctgccttgaccccatctccaggaggggctatggccagagggagtagagggagtccagcccccaagccttgtgaggcactgtta

SEQ ID NO: 288169 - DNA, 2352 bp, Homo sapiens
ccggagagtggtgagatggaatttgtaccaacatagcccttgtgaggagttatcttcattagctatatccatcctttaatccaacacacacctgcaatgattactgtgcaactattttgcttaattttttatttgaaaaaatgtatttaaaagtccaacaactttttaatataaattacgactctcaaacccattcccatcactttattagtgatggtagcatacatattagagaaggtagctaaaggcaagagagcaccaaaggaaaaagactgtccaaagaacaggtattagaatgaggccgaagatcacggtgaccagagatttctaggagtctctaacctttccaccctatcctgttaaccctttagatctctagtataacactcaggctactgaggtattttagagcaacaagctgggttactttcagagcaaccagcttgactggaactgagagtaaattgggaatgtatgaccaatcttagaccctgaaaaatggcagaaaatacatggaaatttgaaaaaaaaaaaaaaaaaaaaaaaaaaaaaaaagaacctcagtcactgttctgtagggataagcaaactgaatgggtggtggaattggcagaatggataccagttcctacattcctgaccccactaccataaaacaggatgtttcctgttgcaaagctaatgagaccccacccttcttgtctcagagcaggcaggagctcatctgtcttgttctgccttcctaattaccctggaagggccagaacgaagaacacctgagaatactgaaagtgcctaaaaacccctgctcctacgttgttttcccatttaaagcagactcttcagccagggggcagtgggacctggtcttcagacaaaactccctgagtctaatgtgtgtctaggactagggcacagaaatagagcttaaaatttggggaggataaggagtgtatctactgcttctctctcccctttccccaatcctaccataccctgttcatatctctacactgcaggaaccacttctccagagggcaagaatggaggagggggacctgtccatcatagcaacatgcaaacacaagcaaaacactgaataaagaattgtttggagattatgtgcagccctactgagcctcatttatatgggctcctagttgatccatggctcgggcttaagatgagtaagatgatgagggtagcgtgccaagcagaaatcacttcagagaaaaatatcttgactttagagttgtggttctcaaatggaggcgattttgccccctaggagaaatctggcaatgtatagagacatttttggttgtcataactagagtgggccaggggtgctgctaaatatcctgtaatgcacaaaataggaaacaggttttccttacaaagaacacttcagcccaaaatgtcaaaggcatctcggttgtgaaaccttgttctagagcctctccctgctcccgtgctgtgaggatcttaagactcctaaactcacagatgattgttttcaacctatttatctcaccatcctcaatgatcagaagtccaccttgagatggacttactcctagttctgccgcattctgggtttctttccagacccctcttcctcctctcacctgggccagcagggaggttggcagagggcaggaaagatgccccaaaacttaaatggaatgtcatcaggtgaagagctacctcttaccttaactcttattcggtgggaaacaaggttcctaatagggatagagttaagggcggaggcaacagcaggatgaggataattaagagaacctgaattaaatttttaatattttaaaaaaggaaagttgctgggaagctggtaaacagaaacagaagattagaggcctaactagaaagagacactggtgttagcagagagatattgaggggctgtaagcctaaggtttgaaatctaaagatagagtggaaaagggagtaggcacccccaccagcccctgcttgacatctgctttagttcattccagcaggaaggaggagaagggcagggaggtagggagcttctcagcaaagccagcttcagctttgataatctcacccacctaccccatttaaggagttccaggtttaagagtttaaaaacaggtggcacccagaccatcattcaggagacaggaactcattccaggttcctagagaactcctatctcagacctgagggtttccagggcttcagctgagctcctctggctaaccagtagtcacttgatcagtcctgctgccttgaccccatctccaggaggggctatggccagagggagtagagggagtccagcccccaagccttgtgaggcactgtta

SEQ ID NO: 288170 - DNA, 2284 bp, Homo sapiens
gcggccgcgtcgacttctaatacctgttctttggacagtctttttattttgcttaattttttatttgaaaaaatgtatttaaaagtccaacaactttttaatataaattacgactctcaaacccattcccatcactttattagtgatggtagcatacatattagagaaggtagctaaaggcaagagagcaccaaaggaaaaagactgtccaaagaacaggtattagaatgaggccgaagatcacggtgaccagagatttctaggagtctctaacctttccaccctatcctgttaaccctttagatctctagtataacactcaggctactgaggtattttagagcaacaagctgggttactttcagagcaaccagcttgactggaactgagagtaaattgggaatgtatgaccaatcttagaccctgaaaaatggcagaaaatacatggaaatttgaaaaaaaaaaaaaaaaaaaaaaaaaaaaaaaagaacctcagtcactgttctgtagggataagcaaactgaatgggtggtggaattggcagaatggataccagttcctacattcctgaccccactaccataaaacaggatgtttcctgttgcaaagctaatgagaccccacccttcttgtctcagagcaggcaggagctcatctgtcttgttctgccttcctaattaccctggaagggccagaacgaagaacacctgagaatactgaaagtgcctaaaaacccctgctcctacgttgttttcccatttaaagcagactcttcagccagggggcagtgggacctggtcttcagacaaaactccctgagtctaatgtgtgtctaggactagggcacagaaatagagcttaaaatttggggaggataaggagtgtatctactgcttctctctcccctttccccaatcctaccataccctgttcatatctctacactgcaggaaccacttctccagagggcaagaatggaggagggggacctgtccatcatagcaacatgcaaacacaagcaaaacactgaataaagaattgtttggagattatgtgcagccctactgagcctcatttatatgggctcctagttgatccatggctcgggcttaagatgagtaagatgatgagggtagcgtgccaagcagaaatcacttcagagaaaaatatcttgactttagagttgtggttctcaaatggaggcgattttgccccctaggagaaatctggcaatgtatagagacatttttggttgtcataactagagtgggccaggggtgctgctaaatatcctgtaatgcacaaaataggaaacaggttttccttacaaagaacacttcagcccaaaatgtcaaaggcatctcggttgtgaaaccttgttctagagcctctccctgctcccgtgctgtgaggatcttaagactcctaaactcacagatgattgttttcaacctatttatctcaccatcctcaatgatcagaagtccaccttgagatggacttactcctagttctgccgcattctgggtttctttccagacccctcttcctcctctcacctgggccagcagggaggttggcagagggcaggaaagatgccccaaaacttaaatggaatgtcatcaggtgaagagctacctcttaccttaactcttattcggtgggaaacaaggttcctaatagggatagagttaagggcggaggcaacagcaggatgaggataattaagagaacctgaattaaatttttaatattttaaaaaaggaaagttgctgggaagctggtaaacagaaacagaagattagaggcctaactagaaagagacactggtgttagcagagagatattgaggggctgtaagcctaaggtttgaaatctaaagatagagtggaaaagggagtaggcacccccaccagcccctgcttgacatctgctttagttcattccagcaggaaggaggagaagggcagggaggtagggagcttctcagcaaagccagcttcagctttgataatctcacccacctaccccatttaaggagttccaggtttaagagtttaaaaacaggtggcacccagaccatcattcaggagacaggaactcattccaggttcctagagaactcctatctcagacctgagggtttccagggcttcagctgagctcctctggctaaccagtagtcacttgatcagtcctgctgccttgaccccatctccaggaggggctatggccagagggagtagagggagtccagcccccaagccttgtgaggcactgtta

SEQ ID NO: 288171 - DNA, 3540 bp, Homo sapiens
ctggataaaaggccttagaaccagttagtgatctgcctacacctgaatccctgaaacatctgaactgttttgtaaatcatcttatccccaacctcagtaccaccggatcttcacttctcagtgggattttgtcctttgcatgaccctactttcagcagggctttgaggctgggaaactgatctgctgggtgactttcattccagttgctgggacggaaggctgaatgtagggtcattttgtatgggatatgcagagctctgggtttttttgttttttgttttttgagacggagtctcgctctgtcgccaggctggagtgcagtggtgcgatctcggctcactgcaacctccgcctcccggttcaagccattcttctgcctcagcctcagcgagtagctgagactaccggcgcacgccaccacgcccagctaattgttttgtatttttagtagagacggggtttcaccatgttggccaggatggtctcgatctcttgacctcgtgatctgcccgcctcggcctcccaaagtgccgagattacaggtgtgagccaccgcgctcggccagagctctgggttttaatcctactttagctgtagaaccttgggcaaataacttcatctttttgggtcctaattttcctcctgtctaactggagggactgtgatccttccaccttggatggaagaggcttacctgacagccagcctgcctgctgggagccaggagagtcagctcattaaatcttgaagaaccgctgtatgccctttttccttctaagtcatgtctgctgcctgtgagcctgggaaggagtgctttcaaaacctgtatttttgccctctttagtaaatttagaactgtagaggctaataaactgcgatgagacatttaaaagctctgctccaaagaagtgaacgactctttcaccaccccttgcatcccaaaccttcggttctggcagagttcttgccgcagaggttccttaggagcaccccgcgcggcccgcgcgagcgcgcatgcgcgtcgaaccccacccccttgccggcgggcctcggttcaaacgacccggtgggtctacagcggaagggagggagcgaaggtaggaggcagggcttgcctcactggccaccctcccaaccccaagagcccagccccatggtccccgccgccggcgcgctgctgtgggtcctgctgctgaatctgggtccccgggcggcgggggcccaaggcctgacccagactccgaccgaaatgcagcgggtcagtttacgctttgggggccccatgacccgcagctaccggagcaccgcccggactggtcttccccggaagacaaggataatcctagaggacgagaatgatgccatggccgacgccgaccgcctggctggaccagcggctgccgagctcttggccgccacggtgtccaccggctttagccggtcgtccgccattaacgaggaggatgggtcttcagaagagggggttgtgattaatgccggaaaggatagcaccagcagagagcttcccagtgcgactcccaatacagcggggagttccagcacgaggtttatagccaatagtcaggagcctgaaatcaggctgacttcaagcctgccgcgctcccccgggaggtctactgaggacctgccaggctcgcaggccaccctgagccagtggtccacacctgggtctaccccgagccggtggccgtcaccctcacccacagccatgccatctcctgaggatctgcggctggtgctgatgccctggggcccgtggcactgccactgcaagtcgggcaccatgagccggagccggtctgggaagctgcacggcctttccgggcgccttcgagttggggcgctgagccagctccgcacggagcacaagccttgcacctatcaacaatgtccctgcaaccgacttcgggaagagtgccccctggacacaagtctctgtactgacaccaactgtgcctctcagagcaccaccagtaccaggaccaccactacccccttccccaccatccacctcagaagcagtcccagcctgccacccgccagcccctgcccagccctggctttttggaaacgggtcaggattggcctggaggatatttggaatagcctctcttcagtgttcacagagatgcaaccaatagacagaaaccagaggtaatggccacttcatccacatgaggagatgaaccacttctccagagggcaagaatggaggagggggacctgtccatcatagcaacatgcaaacacaagcaaaacactgaataaagaattgtttggagattatgtgcagccctactgagcctcatttatatgggctcctagttgatccatggctcgggcttaagatgagtaagatgatgagggtagcgtgccaagcagaaatcacttcagagaaaaatatcttgactttagagttgtggttctcaaatggaggcgattttgccccctaggagaaatctggcaatgtatagagacatttttggttgtcataactagagtgggccaggggtgctgctaaatatcctgtaatgcacaaaataggaaacaggttttccttacaaagaacacttcagcccaaaatgtcaaaggcatctcggttgtgaaaccttgttctagagcctctccctgctcccgtgctgtgaggatcttaagactcctaaactcacagatgattgttttcaacctatttatctcaccatcctcaatgatcagaagtccaccttgagatggacttactcctagttctgccgcattctgggtttctttccagacccctcttcctcctctcacctgggccagcagggaggttggcagagggcaggaaagatgccccaaaacttaaatggaatgtcatcaggtgaagagctacctcttaccttaactcttattcggtgggaaacaaggttcctaatagggatagagttaagggcggaggcaacagcaggatgaggataattaagagaacctgaattaaatttttaatattttaaaaaaggaaagttgctgggaagctggtaaacagaaacagaagattagaggcctaactagaaagagacactggtgttagcagagagatattgaggggctgtaagcctaaggtttgaaatctaaagatagagtggaaaagggagtaggcacccccaccagcccctgcttgacatctgctttagttcattccagcaggaaggaggagaagggcagggaggtagggagcttctcagcaaagccagcttcagctttgataatctcacccacctaccccatttaaggagttccaggtttaagagtttaaaaacaggtggcacccagaccatcattcaggagacaggaactcattccaggttcctagagaactcctatctcagacctgagggtttccagggcttcagctgagctcctctggctaaccagtagtcacttgatcagtcctgctgccttgaccccatctccaggaggggctatggccagagggagtagagggagtccagcccccaagccttgtgaggcactgtta

SEQ ID NO: 288172 - DNA, 4798 bp, Homo sapiens
ctggataaaaggccttagaaccagttagtgatctgcctacacctgaatccctgaaacatctgaactgttttgtaaatcatcttatccccaacctcagtaccaccggatcttcacttctcagtgggattttgtcctttgcatgaccctactttcagcagggctttgaggctgggaaactgatctgctgggtgactttcattccagttgctgggacggaaggctgaatgtagggtcattttgtatgggatatgcagagctctgggtttttttgttttttgttttttgagacggagtctcgctctgtcgccaggctggagtgcagtggtgcgatctcggctcactgcaacctccgcctcccggttcaagccattcttctgcctcagcctcagcgagtagctgagactaccggcgcacgccaccacgcccagctaattgttttgtatttttagtagagacggggtttcaccatgttggccaggatggtctcgatctcttgacctcgtgatctgcccgcctcggcctcccaaagtgccgagattacaggtgtgagccaccgcgctcggccagagctctgggttttaatcctactttagctgtagaaccttgggcaaataacttcatctttttgggtcctaattttcctcctgtctaactggagggactgtgatccttccaccttggatggaagaggcttacctgacagccagcctgcctgctgggagccaggagagtcagctcattaaatcttgaagaaccgctgtatgccctttttccttctaagtcatgtctgctgcctgtgagcctgggaaggagtgctttcaaaacctgtatttttgccctctttagtaaatttagaactgtagaggctaataaactgcgatgagacatttaaaagctctgctccaaagaagtgaacgactctttcaccaccccttgcatcccaaaccttcggttctggcagagttcttgccgcagaggttccttaggagcaccccgcgcggcccgcgcgagcgcgcatgcgcgtcgaaccccacccccttgccggcgggcctcggttcaaacgacccggtgggtctacagcggaagggagggagcgaaggtaggaggcagggcttgcctcactggccaccctcccaaccccaagagcccagccccatggtccccgccgccggcgcgctgctgtgggtcctgctgctgaatctgggtccccgggcggcgggggcccaaggcctgacccagactccgaccgaaatgcagcgggtcagtttacgctttgggggccccatgacccgcagctaccggagcaccgcccggactggtcttccccggaagacaaggataatcctagaggacgagaatgatgccatggccgacgccgaccgcctggctggaccagcggctgccgagctcttggccgccacggtgtccaccggctttagccggtcgtccgccattaacgaggaggatgggtcttcagaagagggggttgtgattaatgccggaaaggatagcaccagcagagagcttcccagtgcgactcccaatacagcggggagttccagcacgaggtttatagccaatagtcaggagcctgaaatcaggctgacttcaagcctgccgcgctcccccgggaggtctactgaggacctgagccatgccatctcctgaggatctgcggctggtgctgatgccctttccgggcgccttcgagttggggcgctgagccagctccgcacggagcacaagccttgcacctatcaacaatgtccctgcaaccgacttcgggaagagtgccccctggacacaagtctctgtactgacaccaactgtgcctctcagagcaccaccagtaccaggaccaccactacccccttccccaccatccacctcagaagcagtcccagcctgccacccgccagcccctgcccagccctggctttttggaaacgggtcaggattggcctggaggatatttggaatagcctctcttcagtgttcacagagatgcaaccaatagacagaaaccagaggtaatggccacttcatccacatgaggagatgtcagtatctcaacctctcttgccctttcaatcctagcacccactagatatttttagtacagaaaaacaaaactggaaaacacattgtttggtcttgtgtttctttacagaggtacctgagggaggagagacataaatcccttcatccctaagactgaactatgtaactagcagcctctggcttgttttctactccctgtccctcaggataaaatgttgatattgctcattttcctcatttccaacattgttttaaaacaagtacttcttttacaggcttgaaaaatctcaaataaacgctaagaaaagggagtaggaagaacaaggagttgagcccttgaaagatgacagtggtcttcttgccttcatgcttggccctctctcctcaaaagggcaatgttggtacaaaattccatctcagccactttcgaggagttatcttcattagctatatccatcctttaatccaacacacacctgcaatgattactgtgcaactattttgcttaattttttatttgaaaaaatgtatttaaaagtccaacaactttttaatataaattacgactctcaaacccattcccatcactttattagtgatggtagcatacatattagagaaggtagctaaaggcaagagagcaccaaaggaaaaagactgtccaaagaacaggtattagaatgaggccgaagatcacggtgaccagagatttctaggagtctctaacctttccaccctatcctgttaaccctttagatctctagtataacactcaggctactgaggtattttagagcaacaagctgggttactttcagagcaaccagcttgactggaactgagagtaaattgggaatgtatgaccaatcttagaccctgaaaaatggcagaaaatacatggaaatttgaaaaaaaaaaaaaaaaaaaaaaaaaaaaaaaagaacctcagtcactgttctgtagggataagcaaactgaatgggtggtggaattggcagaatggataccagttcctacattcctgaccccactaccataaaacaggatgtttcctgttgcaaagctaatgagaccccacccttcttgtctcagagcaggcaggagctcatctgtcttgttctgccttcctaattaccctggaagggccagaacgaagaacacctgagaatactgaaagtgcctaaaaacccctgctcctacgttgttttcccatttaaagcagactcttcagccagggggcagtgggacctggtcttcagacaaaactccctgagtctaatgtgtgtctaggactagggcacagaaatagagcttaaaatttggggaggataaggagtgtatctactgcttctctctcccctttccccaatcctaccataccctgttcatatctctacactgcaggaaccacttctccagagggcaagaatggaggagggggacctgtccatcatagcaacatgcaaacacaagcaaaacactgaataaagaattgtttggagattatgtgcagccctactgagcctcatttatatgggctcctagttgatccatggctcgggcttaagatgagtaagatgatgagggtagcgtgccaagcagaaatcacttcagagaaaaatatcttgactttagagttgtggttctcaaatggaggcgattttgccccctaggagaaatctggcaatgtatagagacatttttggttgtcataactagagtgggccaggggtgctgctaaatatcctgtaatgcacaaaataggaaacaggttttccttacaaagaacacttcagcccaaaatgtcaaaggcatctcggttgtgaaaccttgttctagagcctctccctgctcccgtgctgtgaggatcttaagactcctaaactcacagatgattgttttcaacctatttatctcaccatcctcaatgatcagaagtccaccttgagatggacttactcctagttctgccgcattctgggtttctttccagacccctcttcctcctctcacctgggccagcagggaggttggcagagggcaggaaagatgccccaaaacttaaatggaatgtcatcaggtgaagagctacctcttaccttaactcttattcggtgggaaacaaggttcctaatagggatagagttaagggcggaggcaacagcaggatgaggataattaagagaacctgaattaaatttttaatattttaaaaaaggaaagttgctgggaagctggtaaacagaaacagaagattagaggcctaactagaaagagacactggtgttagcagagagatattgaggggctgtaagcctaaggtttgaaatctaaagatagagtggaaaagggagtaggcacccccaccagcccctgcttgacatctgctttagttcattccagcaggaaggaggagaagggcagggaggtagggagcttctcagcaaagccagcttcagctttgataatctcacccacctaccccatttaaggagttccaggtttaagagtttaaaaacaggtggcacccagaccatcattcaggagacaggaactcattccaggttcctagagaactcctatctcagacctgagggtttccagggcttcagctgagctcctctggctaaccagtagtcacttgatcagtcctgctgccttgaccccatctccaggaggggctatggccagagggagtagagggagtccagcccccaagccttgtgaggcactgtta

SEQ ID NO: 288173 - DNA, 4869 bp, Homo sapiens
ctggataaaaggccttagaaccagttagtgatctgcctacacctgaatccctgaaacatctgaactgttttgtaaatcatcttatccccaacctcagtaccaccggatcttcacttctcagtgggattttgtcctttgcatgaccctactttcagcagggctttgaggctgggaaactgatctgctgggtgactttcattccagttgctgggacggaaggctgaatgtagggtcattttgtatgggatatgcagagctctgggtttttttgttttttgttttttgagacggagtctcgctctgtcgccaggctggagtgcagtggtgcgatctcggctcactgcaacctccgcctcccggttcaagccattcttctgcctcagcctcagcgagtagctgagactaccggcgcacgccaccacgcccagctaattgttttgtatttttagtagagacggggtttcaccatgttggccaggatggtctcgatctcttgacctcgtgatctgcccgcctcggcctcccaaagtgccgagattacaggtgtgagccaccgcgctcggccagagctctgggttttaatcctactttagctgtagaaccttgggcaaataacttcatctttttgggtcctaattttcctcctgtctaactggagggactgtgatccttccaccttggatggaagaggcttacctgacagccagcctgcctgctgggagccaggagagtcagctcattaaatcttgaagaaccgctgtatgccctttttccttctaagtcatgtctgctgcctgtgagcctgggaaggagtgctttcaaaacctgtatttttgccctctttagtaaatttagaactgtagaggctaataaactgcgatgagacatttaaaagctctgctccaaagaagtgaacgactctttcaccaccccttgcatcccaaaccttcggttctggcagagttcttgccgcagaggttccttaggagcaccccgcgcggcccgcgcgagcgcgcatgcgcgtcgaaccccacccccttgccggcgggcctcggttcaaacgacccggtgggtctacagcggaagggagggagcgaaggtaggaggcagggcttgcctcactggccaccctcccaaccccaagggcccaaggcctgacccagactccgaccgaaatgcagcgggtcagtttacgctttgggggccccatgacccgcagctaccggagcaccgcccggactggtcttccccggaagacaaggataatcctagaggacgagaatgatgccatggccgacgccgaccgcctggctggaccagcggctgccgagctcttggccgccacggtgtccaccggctttagccggtcgtccgccattaacgaggaggatgggtcttcagaagagggggttgtgattaatgccggaaaggatagcaccagcagagagcttcccagtgcgactcccaatacagcggggagttccagcacgaggtttatagccaatagtcaggagcctgaaatcaggctgacttcaagcctgccgcgctcccccgggaggtctactgaggacctgccaggctcgcaggccaccctgagccagtggtccacacctgggtctaccccgagccggtggccgtcaccctcacccacagccatgccatctcctgaggatctgcggctggtgctgatgccctggggcccgtggcactgccactgcaagtcgggcaccatgagccggagccggtctgggaagctgcacggcctttccgggcgccttcgagttggggcgctgagccagctccgcacggagcacaagccttgcacctatcaacaatgtccctgcaaccgacttcgggaagagtgccccctggacacaagtctctgtactgacaccaactgtgcctctcagagcaccaccagtaccaggaccaccactacccccttccccaccatccacctcagaagcagtcccagcctgccacccgccagcccctgcccagccctggctttttggaaacgggtcaggattggcctggaggatatttggaatagcctctcttcagtgttcacagagatgcaaccaatagacagaaaccagaggtaatggccacttcatccacatgaggagatgtcagtatctcaacctctcttgccctttcaatcctagcacccactagatatttttagtacagaaaaacaaaactggaaaacacattgtttggtcttgtgtttctttacagaggtacctgagggaggagagacataaatcccttcatccctaagactgaactatgtaactagcagcctctggcttgttttctactccctgtccctcaggataaaatgttgatattgctcattttcctcatttccaacattgttttaaaacaagtacttcttttacaggcttgaaaaatctcaaataaacgctaagaaaagggagtaggaagaacaaggagttgagcccttgaaagatgacagtggtcttcttgccttcatgcttggccctctctcctcaaaagggcaatgttggtacaaaattccatctcagccactttcgaggagttatcttcattagctatatccatcctttaatccaacacacacctgcaatgattactgtgcaactattttgcttaattttttatttgaaaaaatgtatttaaaagtccaacaactttttaatataaattacgactctcaaacccattcccatcactttattagtgatggtagcatacatattagagaaggtagctaaaggcaagagagcaccaaaggaaaaagactgtccaaagaacaggtattagaatgaggccgaagatcacggtgaccagagatttctaggagtctctaacctttccaccctatcctgttaaccctttagatctctagtataacactcaggctactgaggtattttagagcaacaagctgggttactttcagagcaaccagcttgactggaactgagagtaaattgggaatgtatgaccaatcttagaccctgaaaaatggcagaaaatacatggaaatttgaaaaaaaaaaaaaaaaaaaaaaaaaaaaaaaagaacctcagtcactgttctgtagggataagcaaactgaatgggtggtggaattggcagaatggataccagttcctacattcctgaccccactaccataaaacaggatgtttcctgttgcaaagctaatgagaccccacccttcttgtctcagagcaggcaggagctcatctgtcttgttctgccttcctaattaccctggaagggccagaacgaagaacacctgagaatactgaaagtgcctaaaaacccctgctcctacgttgttttcccatttaaagcagactcttcagccagggggcagtgggacctggtcttcagacaaaactccctgagtctaatgtgtgtctaggactagggcacagaaatagagcttaaaatttggggaggataaggagtgtatctactgcttctctctcccctttccccaatcctaccataccctgttcatatctctacactgcaggaaccacttctccagagggcaagaatggaggagggggacctgtccatcatagcaacatgcaaacacaagcaaaacactgaataaagaattgtttggagattatgtgcagccctactgagcctcatttatatgggctcctagttgatccatggctcgggcttaagatgagtaagatgatgagggtagcgtgccaagcagaaatcacttcagagaaaaatatcttgactttagagttgtggttctcaaatggaggcgattttgccccctaggagaaatctggcaatgtatagagacatttttggttgtcataactagagtgggccaggggtgctgctaaatatcctgtaatgcacaaaataggaaacaggttttccttacaaagaacacttcagcccaaaatgtcaaaggcatctcggttgtgaaaccttgttctagagcctctccctgctcccgtgctgtgaggatcttaagactcctaaactcacagatgattgttttcaacctatttatctcaccatcctcaatgatcagaagtccaccttgagatggacttactcctagttctgccgcattctgggtttctttccagacccctcttcctcctctcacctgggccagcagggaggttggcagagggcaggaaagatgccccaaaacttaaatggaatgtcatcaggtgaagagctacctcttaccttaactcttattcggtgggaaacaaggttcctaatagggatagagttaagggcggaggcaacagcaggatgaggataattaagagaacctgaattaaatttttaatattttaaaaaaggaaagttgctgggaagctggtaaacagaaacagaagattagaggcctaactagaaagagacactggtgttagcagagagatattgaggggctgtaagcctaaggtttgaaatctaaagatagagtggaaaagggagtaggcacccccaccagcccctgcttgacatctgctttagttcattccagcaggaaggaggagaagggcagggaggtagggagcttctcagcaaagccagcttcagctttgataatctcacccacctaccccatttaaggagttccaggtttaagagtttaaaaacaggtggcacccagaccatcattcaggagacaggaactcattccaggttcctagagaactcctatctcagacctgagggtttccagggcttcagctgagctcctctggctaaccagtagtcacttgatcagtcctgctgccttgaccccatctccaggaggggctatggccagagggagtagagggagtccagcccccaagccttgtgaggcactgtta

SEQ ID NO: 288174 - DNA, 4599 bp, Homo sapiens
ctggataaaaggccttagaaccagttagtgatctgcctacacctgaatccctgaaacatctgaactgttttgtaaatcatcttatccccaacctcagtaccaccggatcttcacttctcagtgggattttgtcctttgcatgaccctactttcagcagggctttgaggctgggaaactgatctgctgggtgactttcattccagttgctgggacggaaggctgaatgtagggtcattttgtatgggatatgcagagctctgggtttttttgttttttgttttttgagacggagtctcgctctgtcgccaggctggagtgcagtggtgcgatctcggctcactgcaacctccgcctcccggttcaagccattcttctgcctcagcctcagcgagtagctgagactaccggcgcacgccaccacgcccagctaattgttttgtatttttagtagagacggggtttcaccatgttggccaggatggtctcgatctcttgacctcgtgatctgcccgcctcggcctcccaaagtgccgagattacaggtgtgagccaccgcgctcggccagagctctgggttttaatcctactttagctgtagaaccttgggcaaataacttcatctttttgggtcctaattttcctcctgtctaactggagggactgtgatccttccaccttggatggaagaggcttacctgacagccagcctgcctgctgggagccaggagagtcagctcattaaatcttgaagaaccgctgtatgccctttttccttctaagtcatgtctgctgcctgtgagcctgggaaggagtgctttcaaaacctgtatttttgccctctttagtaaatttagaactgtagaggctaataaactgcgatgagacatttaaaagctctgctccaaagaagtgaacgactctttcaccaccccttgcatcccaaaccttcggttctggcagagttcttgccgcagaggttccttaggagcaccccgcgcggcccgcgcgagcgcgcatgcgcgtcgaaccccacccccttgccggcgggcctcggttcaaacgacccggtgggtctacagcggaagggagggagcgaaggtaggaggcagggcttgcctcactggccaccctcccaaccccaagagcccagccccatggtccccgccgccggcgcgctgctgtgggtcctgctgctgaatctgggtccccgggcggcgggggcccaaggcctgacccagactccgaccgaaatgcagcgggtcagtttacgctttgggggccccatgacccgcagctaccggagcaccgcccggactggtcttccccggaagacaaggataatcctagaggacgagaatgatgccatggccgacgccgaccgcctggctggaccagcggctgccgagctcttggccgccacggtgtccaccggctttagccggtcgtccgccattaacgaggaggatgggtcttcagaagagggggttgtgattaatgccggaaaggatagcaccagcagagagcttcccagtgcgactcccaatacagcggggagttccagcacgaggtttatagccaatagtcaggagcctgaaatcaggctgacttcaagcctgccgcgctcccccgggaggtctactgaggacctgccaggctcgcaggccaccctgagccagtggtccacacctgggtctaccccgagccggtggccgtcaccctcacccacccagccctggctttttggaaacgggtcaggattggcctggaggatatttggaatagcctctcttcagtgttcacagagatgcaaccaatagacagaaaccagaggtaatggccacttcatccacatgaggagatgtcagtatctcaacctctcttgccctttcaatcctagcacccactagatatttttagtacagaaaaacaaaactggaaaacacattgtttggtcttgtgtttctttacagaggtacctgagggaggagagacataaatcccttcatccctaagactgaactatgtaactagcagcctctggcttgttttctactccctgtccctcaggataaaatgttgatattgctcattttcctcatttccaacattgttttaaaacaagtacttcttttacaggcttgaaaaatctcaaataaacgctaagaaaagggagtaggaagaacaaggagttgagcccttgaaagatgacagtggtcttcttgccttcatgcttggccctctctcctcaaaagggcaatgttggtacaaaattccatctcagccactttcgaggagttatcttcattagctatatccatcctttaatccaacacacacctgcaatgattactgtgcaactattttgcttaattttttatttgaaaaaatgtatttaaaagtccaacaactttttaatataaattacgactctcaaacccattcccatcactttattagtgatggtagcatacatattagagaaggtagctaaaggcaagagagcaccaaaggaaaaagactgtccaaagaacaggtattagaatgaggccgaagatcacggtgaccagagatttctaggagtctctaacctttccaccctatcctgttaaccctttagatctctagtataacactcaggctactgaggtattttagagcaacaagctgggttactttcagagcaaccagcttgactggaactgagagtaaattgggaatgtatgaccaatcttagaccctgaaaaatggcagaaaatacatggaaatttgaaaaaaaaaaaaaaaaaaaaaaaaaaaaaaaagaacctcagtcactgttctgtagggataagcaaactgaatgggtggtggaattggcagaatggataccagttcctacattcctgaccccactaccataaaacaggatgtttcctgttgcaaagctaatgagaccccacccttcttgtctcagagcaggcaggagctcatctgtcttgttctgccttcctaattaccctggaagggccagaacgaagaacacctgagaatactgaaagtgcctaaaaacccctgctcctacgttgttttcccatttaaagcagactcttcagccagggggcagtgggacctggtcttcagacaaaactccctgagtctaatgtgtgtctaggactagggcacagaaatagagcttaaaatttggggaggataaggagtgtatctactgcttctctctcccctttccccaatcctaccataccctgttcatatctctacactgcaggaaccacttctccagagggcaagaatggaggagggggacctgtccatcatagcaacatgcaaacacaagcaaaacactgaataaagaattgtttggagattatgtgcagccctactgagcctcatttatatgggctcctagttgatccatggctcgggcttaagatgagtaagatgatgagggtagcgtgccaagcagaaatcacttcagagaaaaatatcttgactttagagttgtggttctcaaatggaggcgattttgccccctaggagaaatctggcaatgtatagagacatttttggttgtcataactagagtgggccaggggtgctgctaaatatcctgtaatgcacaaaataggaaacaggttttccttacaaagaacacttcagcccaaaatgtcaaaggcatctcggttgtgaaaccttgttctagagcctctccctgctcccgtgctgtgaggatcttaagactcctaaactcacagatgattgttttcaacctatttatctcaccatcctcaatgatcagaagtccaccttgagatggacttactcctagttctgccgcattctgggtttctttccagacccctcttcctcctctcacctgggccagcagggaggttggcagagggcaggaaagatgccccaaaacttaaatggaatgtcatcaggtgaagagctacctcttaccttaactcttattcggtgggaaacaaggttcctaatagggatagagttaagggcggaggcaacagcaggatgaggataattaagagaacctgaattaaatttttaatattttaaaaaaggaaagttgctgggaagctggtaaacagaaacagaagattagaggcctaactagaaagagacactggtgttagcagagagatattgaggggctgtaagcctaaggtttgaaatctaaagatagagtggaaaagggagtaggcacccccaccagcccctgcttgacatctgctttagttcattccagcaggaaggaggagaagggcagggaggtagggagcttctcagcaaagccagcttcagctttgataatctcacccacctaccccatttaaggagttccaggtttaagagtttaaaaacaggtggcacccagaccatcattcaggagacaggaactcattccaggttcctagagaactcctatctcagacctgagggtttccagggcttcagctgagctcctctggctaaccagtagtcacttgatcagtcctgctgccttgaccccatctccaggaggggctatggccagagggagtagagggagtccagcccccaagccttgtgaggcactgtta

SEQ ID NO: 288175 - DNA, 701 bp, Homo sapiens
tcacgtgcctgcgccggcagcgctcccactttcctgtccggtgcggccccgggtccctgtattttgggtccggcctgctcgccgtccgctccgtccgcccttagacctgttgcccagcatccctgcagttcgcggtacagtctctagtagagcgcgtgtatagaggcagagaggagtgaagtccacagttcctctcctccaagagcctgccgaccatgcccgcgggcgtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaatataatgcgaaatagaatatttgtaagtcta

SEQ ID NO: 288176 - DNA, 1530 bp, Homo sapiens
tcacgtgcctgcgccggcagcgctcccactttcctgtccggtgcggccccgggtccctgtattttgggtccggcctgctcgccgtccgctccgtccgcccttagacctgttgcccagcatccctgcagttcgcggtacagtctctagtagagcgcgtgtatagaggcagagaggagtgaagtccacagttcctctcctccaagaggtagaaggggcgcggggaaacgacctggtatcggttttccgcttgctgatcaagagctccctttaatgccgcacgcaggccggcgcccctcactgataaacgattggggctgggcctcggcctggagggcgttcgtcctctcagtgccctcagctcgtaaaggaggaaaccgaggcgtggggttgggcgagaacccaggggtcctcctgcacccccgccgccgtgtgtctcgtgtccagcgctggctggagcgcctcagccctggcgcggtgtagtcgtgagctggaacttctgacactgccccttccttccccgtccagcctgccgaccatgcccgcgggcgtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaatataatgcgaaatagaatatttgtaagtctactatatgggttgtctttatttcatataaattaagaaattatttaaaactatgaactagtttcattaattgaatttgctaagtggagttatttctcattgctaaactgttttttttcaaattctagatctctgctaactttagtaaatgaacactaaagtggtgagctttgataatgcattttgtggatacaaaatcatcgcctcatcactttctagaatgaaaggctgggggcattgctcaccttttgcgtgaagaaaagacctgtcccttagagccagtttttgcttaaggggaggacagaccgtcgtcacccagtggaccacgtgaatgaatggatgcagtgcatgctttagaagcaccgcatacctccttttacaggtacagagtaagtggtctggctactgagggaaagagtcatgatttgaatccgagtcttctgtaagacaatgacttcatgaaggtgaaaaatcagttttatggttattaaagtaaaaatttaccttgggta

SEQ ID NO: 288177 - DNA, 744 bp, Homo sapiens
acgcagaagacggggactaggagcgctctgccgacgtcagcttttgtctccagtattttcgggggctggtggacgcgtgggcgatagggtgctgtccttggggtgctgtgtatatgggatgatgacgcttatcagcattatctagtcctttccaccccgaaattcgccccgattaaagactgtgttgcattatcaggtaatgagatgtgagggagggtctttgaaagtggaaaacctgggcgtcgaggccactgtgccatcttgggcctcagtttccttatctgtgaaatgagggtgaatgtaaagctgctatgtaaaatgtaaagctctacataaaccactctctgcattactttggatatatgagaatattaacgtttgacgtctacgagactagatcccattcgagcatcacctcccataaccttacagactaacccctcttttaaatctcagtggttcgtaatcttacagactaacccctcttttatgtctcagtggttcttgcagctggcttttgtttcattagttctcaatttctgtcactggtgtttgtactttattaaggaactcttaatggaataggcttttgggtttttctagtttgcaggatgatgaaaaacatggctgctgtatttgttggctttcctgagtttattcatatagtaacaggtaactccaaaccttcagtggtttacagccacagaagtttatttctcactcacgtgatctgtgagctgggag

SEQ ID NO: 288178 - DNA, 2066 bp, Homo sapiens
  misc_feature (1691)..(1691): n is a, c, g, or t
  misc_feature (1858)..(1858): n is a, c, g, or t
tcacgtgcctgcgccggcagcgctcccactttcctgtccggtgcggccccgggtccctgtattttgggtccggcctgctcgccgtccgctccgtccgcccttagacctgttgcccagcatccctgcagttcgcggtacagtctctagtagagcgcgtgtatagaggcagagaggagtgaagtccacagttcctctcctccaagaggtagaaggggcgcggggaaacgacctggtatcggttttccgcttgctgatcaagagctccctttaatgccgcacgcaggccggcgcccctcactgataaacgattggggctgggcctcggcctggagggcgttcgtcctctcagtgccctcagctcgtaaaggaggaaaccgaggcgtggggttgggcgagaacccaggggtcctcctgcacccccgccgccgtgtgtctcgtgtccagcgctggctggagcgcctcagccctggcgcggtgtagtcgtgagctggaacttctgacactgccccttccttccccgtccagcctgccgaccatgcccgcgggcgtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaatataatgcgaaatagaatatttgtaagtctactatatgggttgtctttatttcatataaattaagaaattatttaaaactatgaactagtttcattaattgaatttgctaagtggagttatttctcattgctaaactgttttttttcaaattctagatctctgctaactttagtaaatgaacactaaagtggtgagctttgataatgcattttgtggatacaaaatcatcgcctcatcactttctagaatgaaaggctgggggcattgctcaccttttgcgtgaagaaaagacctgtcccttagagccagtttttgcttaaggggaggacagaccgtcgtcacccagtggaccacgtgaatgaatggatgcagtgcatgctttagaagcaccgcatacctccttttacaggtacagagtaagtggtctggctactgagggaaagagtcatgatttgaatccgagtcttctgtaagacaatgacttcatgaaggtgaaaaatcagttttatggttattaaagtaaaaatttaccttgggtaaaaatgccatctttatttcattaagtactggttctaagtgacttccaataagatacattttcttcctgttttgaagttgatccccattgtgaaaaatatacattgtagtggtcatggaaatgcgccatccatactccctaaggcaggcttgttgccctagnatcaagcatgccagcagctttcaatggtcagcttctagaaggattgcctcggctatggtggccttgctcaaagccatgcctcctgaaggggcccaaatccagtgactgttggaggtgagaatagaaaggcctggccacttcagcacgtgagtggtgggcaactctgntgggcccaccacaactccctatggggtttagggacactgtctttggatctgcattgcaactcaacttatacctctgctcagtcctgtttcctttctcaggtgttgatcgaagggtgtgccttcatagaccccctgctaaactgcacctcagtgtttcttggagaaccaaatctgtaacatatatgcattaaaaattaaaggcagtact

SEQ ID NO: 288179 - DNA, 1210 bp, Homo sapiens
tcacgtgcctgcgccggcagcgctcccactttcctgtccggtgcggccccgggtccctgtattttgggtccggcctgctcgccgtccgctccgtccgcccttagacctgttgcccagcatccctgcagttcgcggtacagtctctagtagagcgcgtgtatagaggcagagaggagtgaagtccacagttcctctcctccaagagcctgccgaccatgcccgcgggcgtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaatataatgcgaaatagaatatttgtaagtctactatatgggttgtctttatttcatataaattaagaaattatttaaaactatgaactagtttcattaattgaatttgctaagtggagttatttctcattgctaaactgttttttttcaaattctagatctctgctaactttagtaaatgaacactaaagtggtgagctttgataatgcattttgtggatacaaaatcatcgcctcatcactttctagaatgaaaggctgggggcattgctcaccttttgcgtgaagaaaagacctgtcccttagagccagtttttgcttaaggggaggacagaccgtcgtcacccagtggaccacgtgaatgaatggatgcagtgcatgctttagaagcaccgcatacctccttttacaggtacagagtaagtggtctggctactgagggaaagagtcatgatttgaatccgagtcttctgtaagacaatgacttcatgaaggtgaaaaatcagttttatggttattaaagtaaaaatttaccttgggta

SEQ ID NO: 288180 - DNA, 1139 bp, Homo sapiens
tcacgtgcctgcgccggcagcgctcccactttcctgtccggtgcggccccgggtccctgtattttgggtccggcctgctcgccgtccgctccgtccgcccttagacctgttgcccagcatccctgcagttcgcgcctgccgaccatgcccgcgggcgtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaatataatgcgaaatagaatatttgtaagtctactatatgggttgtctttatttcatataaattaagaaattatttaaaactatgaactagtttcattaattgaatttgctaagtggagttatttctcattgctaaactgttttttttcaaattctagatctctgctaactttagtaaatgaacactaaagtggtgagctttgataatgcattttgtggatacaaaatcatcgcctcatcactttctagaatgaaaggctgggggcattgctcaccttttgcgtgaagaaaagacctgtcccttagagccagtttttgcttaaggggaggacagaccgtcgtcacccagtggaccacgtgaatgaatggatgcagtgcatgctttagaagcaccgcatacctccttttacaggtacagagtaagtggtctggctactgagggaaagagtcatgatttgaatccgagtcttctgtaagacaatgacttcatgaaggtgaaaaatcagttttatggttattaaagtaaaaatttaccttgggta

SEQ ID NO: 288181 - DNA, 1201 bp, Homo sapiens
acgcagaagacggggactaggagcgctctgccgacgtcagcttttgtctccagtattttcgggggctggtggacgcgtgggcgatagggtgctgtccttggggtgctgtgtatatgggatgatgacgcttatcagcattatctagtcctttccaccccgaaattcgccccgattaaagactgtgttgcattatcagcctgccgaccatgcccgcgggcgtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaatataatgcgaaatagaatatttgtaagtctactatatgggttgtctttatttcatataaattaagaaattatttaaaactatgaactagtttcattaattgaatttgctaagtggagttatttctcattgctaaactgttttttttcaaattctagatctctgctaactttagtaaatgaacactaaagtggtgagctttgataatgcattttgtggatacaaaatcatcgcctcatcactttctagaatgaaaggctgggggcattgctcaccttttgcgtgaagaaaagacctgtcccttagagccagtttttgcttaaggggaggacagaccgtcgtcacccagtggaccacgtgaatgaatggatgcagtgcatgctttagaagcaccgcatacctccttttacaggtacagagtaagtggtctggctactgagggaaagagtcatgatttgaatccgagtcttctgtaagacaatgacttcatgaaggtgaaaaatcagttttatggttattaaagtaaaaatttaccttgggta

SEQ ID NO: 288182 - DNA, 1204 bp, Homo sapiens
acgcagaagacggggactaggagcgctctgccgacgtcagcttttgtctccagtattttcgggggctggtggacgcgtgggcgatagggtgctgtccttggggtgctgtgtatatgggatgatgacgcttatcagcattatctagtcctttccaccccgaaattcgccccgattaaagactgtgttgcattatcagcaaaactggatcacaagtctttcggtcggagaactggaaggtctgggcagagtcgagcagaggagaccatgatgactgcctagacttgtgctcagtgctgtgttggggagaactgctacagacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaatataatgcgaaatagaatatttgtaagtctactatatgggttgtctttatttcatataaattaagaaattatttaaaactatgaactagtttcattaattgaatttgctaagtggagttatttctcattgctaaactgttttttttcaaattctagatctctgctaactttagtaaatgaacactaaagtggtgagctttgataatgcattttgtggatacaaaatcatcgcctcatcactttctagaatgaaaggctgggggcattgctcaccttttgcgtgaagaaaagacctgtcccttagagccagtttttgcttaaggggaggacagaccgtcgtcacccagtggaccacgtgaatgaatggatgcagtgcatgctttagaagcaccgcatacctccttttacaggtacagagtaagtggtctggctactgagggaaagagtcatgatttgaatccgagtcttctgtaagacaatgacttcatgaaggtgaaaaatcagttttatggttattaaagtaaaaatttaccttgggta

SEQ ID NO: 288183 - DNA, 1021 bp, Homo sapiens
tcacgtgcctgcgccggcagcgctcccactttcctgtccggtgcggccccgggtccctgtattttgggtccggcctgctcgccgtccgctccgtccgcccttagacctgttgcccagcatccctgcagttcgcggtacagtctctagtagagcgcgtgtatagaggcagagaggagtgaagtccacagttcctctcctccaagaggtagaaggggcgcggggaaacgacctggtatcggttttccgcttgctgatcaagagctccctttaatgccgcacgcaggccggcgcccctcactgataaacgattggggctgggcctcggcctggagggcgttcgtcctctcagtgccctcagctcgtaaaggaggaaaccgaggcgtggggttgggcgagaacccaggggtcctcctgcacccccgccgccgtgtgtctcgtgtccagcgctggctggagcgcctcagccctggcgcggtgtagtcgtgagctggaacttctgacactgccccttccttccccgtccagcctgccgaccatgcccgcgggcgtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaatataatgcgaaatagaatatttgtaagtcta

SEQ ID NO: 288184 - DNA, 1476 bp, Homo sapiens
tcacgtgcctgcgccggcagcgctcccactttcctgtccggtgcggccccgggtccctgtattttgggtccggcctgctcgccgtccgctccgtccgcccttagacctgttgcccagcatccctgcagttcgcggtacagtctctagtagagcgcgtgtatagaggcagagaggagtgaagtccacagttcctctcctccaagaggtagaaggggcgcggggaaacgacctggtatcggttttccgcttgctgatcaagagctccctttaatgccgcacgcaggccggcgcccctcactgataaacgattggggctgggcctcggcctggagggcgttcgtcctctcagtgccctcagctcgtaaaggaggaaaccgaggcgtggggttgggcgagaacccaggggtcctcctgcacccccgccgccgtgtgtctcgtgtccagcgctggctggagcgcctcagccctggcgcggtgtagtcgtgagctggaacttctgacactgccccttccttccccgtccagcctgccgaccatgcccgcgggcgtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaagaaagattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaatataatgcgaaatagaatatttgtaagtctactatatgggttgtctttatttcatataaattaagaaattatttaaaactatgaactagtttcattaattgaatttgctaagtggagttatttctcattgctaaactgttttttttcaaattctagatctctgctaactttagtaaatgaacactaaagtggtgagctttgataatgcattttgtggatacaaaatcatcgcctcatcactttctagaatgaaaggctgggggcattgctcaccttttgcgtgaagaaaagacctgtcccttagagccagtttttgcttaaggggaggacagaccgtcgtcacccagtggaccacgtgaatgaatggatgcagtgcatgctttagaagcaccgcatacctccttttacaggtacagagtaagtggtctggctactgagggaaagagtcatgatttgaatccgagtcttctgtaagacaatgacttcatgaaggtgaaaaatcagttttatggttattaaagtaaaaatttaccttgggta

SEQ ID NO: 288185 - DNA, 1133 bp, Homo sapiens
  misc_feature (966)..(966): n is a, c, g, or t
  misc_feature (1007)..(1007): n is a, c, g, or t
tcacgtgcctgcgccggcagcgctcccactttcctgtccggtgcggccccgggtccctgtattttgggtccggcctgctcgccgtccgctccgtccgcccttagacctgttgcccagcatccctgcagttcgcggtacagtctctagtagagcgcgtgtatagaggcagagaggagtgaagtccacagttcctctcctccaagaggtagaaggggcgcggggaaacgacctggtatcggttttccgcttgctgatcaagagctccctttaatgccgcacgcaggccggcgcccctcactgataaacgattggggctgggcctcggcctggagggcgttcgtcctctcagtgccctcagctcgtaaaggaggaaaccgaggcgtggggttgggcgagaacccaggggtcctcctgcacccccgccgccgtgtgtctcgtgtccagcgctggctggagcgcctcagccctggcgcggtgtagtcgtgagctggaacttctgacactgccccttccttccccgtccagcctgccgaccatgcccgcgggcgtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaacctcgtgccgaattcngcacgagggaaaaggctcgccttgccgcacaggagcagcanaaggaaatggaaagccaaaaccaggcttgagaaggcgcatctggcaaagctgagaaaagacgtctggagaaacctagaatcaagtcaatgaacacgggcaaacaaaagtgacaaccctcgtgggaa

SEQ ID NO: 288186 - DNA, 1302 bp, Homo sapiens
tcacgtgcctgcgccggcagcgctcccactttcctgtccggtgcggccccgggtccctgtattttgggtccggcctgctcgccgtccgctccgtccgcccttagacctgttgcccagcatccctgcagttcgcggtacagtctctagtagagcgcgtgtatagaggcagagaggagtgaagtccacagttcctctcctccaagaggtagaaggggcgcggggaaacgacctggtatcggttttccgcttgctgatcaagagctccctttaatgccgcacgcaggccggcgcccctcactgataaacgattggggctgggcctcggcctggagggcgttcgtcctctcagtgccctcagctcgtaaaggaggaaaccgaggcgtggggttgggcgagaacccaggggtcctcctgcacccccgccgccgtgtgtctcgtgtccagcgctggctggagcgcctcagccctggcgcggtgtagtcgtgagctggaacttctgacactgccccttccttccccgtccagcctgccgaccatgcccgcgggcgtgcccatgtccacctacctgaaaatgttcgcagccagtctcctggccatgtgcgcaggggcagaagtggtgcacaggtactaccgaccggacctggtgtgaatagtggtttggagcacaatgttgggagcagtcatttctgtttggactctgcctggacagatgagaaacaggttgagaagagtgaagttgatttctcaaagtcacatagcttagtgagacgatttgaggatctgaagcccaagctttctgtttgcaaaactggatcacaagtctttcggtcggagaactggaaggtctgggcagagtcgagcagaggagaccatgatgactgcctagacttgtgctcagtgctgtgttggggagaactgctacagacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaatataatgcgaaatagaatatttgtaagtcta

SEQ ID NO: 288187 - DNA, 1811 bp, Homo sapiens
tcacgtgcctgcgccggcagcgctcccactttcctgtccggtgcggccccgggtccctgtattttgggtccggcctgctcgccgtccgctccgtccgcccttagacctgttgcccagcatccctgcagttcgcggtacagtctctagtagagcgcgtgtatagaggcagagaggagtgaagtccacagttcctctcctccaagaggtagaaggggcgcggggaaacgacctggtatcggttttccgcttgctgatcaagagctccctttaatgccgcacgcaggccggcgcccctcactgataaacgattggggctgggcctcggcctggagggcgttcgtcctctcagtgccctcagctcgtaaaggaggaaaccgaggcgtggggttgggcgagaacccaggggtcctcctgcacccccgccgccgtgtgtctcgtgtccagcgctggctggagcgcctcagccctggcgcggtgtagtcgtgagctggaacttctgacactgccccttccttccccgtccagcctgccgaccatgcccgcgggcgtgcccatgtccacctacctgaaaatgttcgcagccagtctcctggccatgtgcgcaggggcagaagtggtgcacaggtactaccgaccggacctggtgtgaatagtggtttggagcacaatgttgggagcagtcatttctgtttggactctgcctggacagatgagaaacaggttgagaagagtgaagttgatttctcaaagtcacatagcttagtgagacgatttgaggatctgaagcccaagctttctgtttgcaaaactggatcacaagtctttcggtcggagaactggaaggtctgggcagagtcgagcagaggagaccatgatgactgcctagacttgtgctcagtgctgtgttggggagaactgctacagacaatacctgaaattccaccaaagcgtggagaactcaaaacggagcttttgggactgaaagaaagaaaacacaaacctcaagtttctcaacaggaggaacttaaataactatgccaagaattctgtgaataatataagtcttaaatatgtatttcttaatttattgcatcaaactacttgtccttaagcacttagtctaatgctaactgcaagaggaggtgctcagtggatgtttagccgatacgttgaaatttaattacggtttgattgatatttcttgaaaactgccaaagcacatatcatcaaaccatttcatgaatatggtttggaagatgtttagtcttgaatataatgcgaaatagaatatttgtaagtctactatatgggttgtctttatttcatataaattaagaaattatttaaaactatgaactagtttcattaattgaatttgctaagtggagttatttctcattgctaaactgttttttttcaaattctagatctctgctaactttagtaaatgaacactaaagtggtgagctttgataatgcattttgtggatacaaaatcatcgcctcatcactttctagaatgaaaggctgggggcattgctcaccttttgcgtgaagaaaagacctgtcccttagagccagtttttgcttaaggggaggacagaccgtcgtcacccagtggaccacgtgaatgaatggatgcagtgcatgctttagaagcaccgcatacctccttttacaggtacagagtaagtggtctggctactgagggaaagagtcatgatttgaatccgagtcttctgtaagacaatgacttcatgaaggtgaaaaatcagttttatggttattaaagtaaaaatttaccttgggta

SEQ ID NO: 288188 - DNA, 1844 bp, Homo sapiens
catgttggtcaggctggtctcaaactcctcaccttgtgatctgcccacctcggcctcccaaagtgctgggattacaggcatgagccaccgcgcccagcccacctggggcatttttgttgctgtacaatagaaacaagttctctatatgttccccaggctggtccaaactcctgggctcaagtgatcctcccacctagacctcccaaagtgctgggatttcaggcatgagccgcagtggccggtcagaacctggggcccttttgaactttgattcctcagcaattttgtcagccctggctcgggctgagaagcccctgtgaagccagagagggaaagggacctgtccagggtcacacaggaatcatgcgtcaagcctccccagccacggacttgtctccatccagggcatttcagcccctgcagggcagtggcctgcccctcctccttggagccaggaagggatgcagtgccacagggatctggctctgtcccaggccctgtggggctggcagttgagtaagcagtcaggctgggcgcaccgcatccctcccccactccccactgcccagcacagtgcattcatgcagctgggccccaccccatctccagaggcaccttccactagcaacagtctccccaggcacaacacagctaacacaaggccccgcaggcaggactctgggacagacgcaggccagctgcccagagcccagaccaagcatggacgccgtggatgccaccatggagaaactccgggcacagtgcctgtcccgcggggcctcgggcatccagggcctggccaggtttttccgccaactagaccgggacgggagcagatccctggacgctgatgagttccggcagggtctggccaaactcgggctggtgctggaccaggcggaggcagagggtgtgtgcaggaagtgggaccgcaatggcagcgggacgctggatctggaggagttccttcgggcgctgcggccccccatgtcccaggcccgggaggctgtcatcgcagctgcatttgccaagctggaccgcagtggggacggcgtcgtgacggtggacgacctccgcggggtgtacagtggccgtgcccaccccaaggtgcgcagtggggagtggaccgaggacgaggtgctgcgccgcttcctggacaacttcgactcctctgagaaggacgggcaggtcacactggcggaattccagggactactacagcggcgtgagtgcctccatgaacacggatgaggagttcgtggccatgatgaccagtgcctggcagctgtgagcagctccggctcagccctgctgccctggcctgtcactccccacccctgccggagacctcccttccctgggccccttctctcctgggcagccacaccacagagcggggaggggcaggtgggggaatggaggctgcaggactggctagaccaggtccctgccggtccaccaggcggaggtgggacaaaggtcctaacaggagtcactggctcaggaccccagggagaaacgctctccccacccacgccatgctgaccagaggtcttgcagcccctgtggatgcccccgccgaggtcccccgatccccgcacccggactgctgctccctgcccctcccttgcgggtcccccaggaagccaggtgaccccaggtgggaggctgtgtgtggaggccatcctggaaggaagtttagacctgcccaggtgtggagcgaggggcacaggggcatcctaacctcagaaactgaaataaagcctttgaaaaaaaaatctgtaaaacatcaacccccaatcagaagatggcaaatggggaataaaaatagcaggtaacacgtc

SEQ ID NO: 288189 - DNA, 2184 bp, Homo sapiens
catgttggtcaggctggtctcaaactcctcaccttgtgatctgcccacctcggcctcccaaagtgctgggattacaggcatgagccaccgcgcccagcccacctggggcatttttgttgctgtacaatagaaacaagttctctatatgttccccaggctggtccaaactcctgggctcaagtgatcctcccacctagacctcccaaagtgctgggatttcaggcatgagccgcagtggccggtcagaacctggggcccttttgaactttgattcctcagcaattttgtcagccctggctcgggctgagaagcccctgtgaagccagagagggaaagggacctgtccagggtcacacaggaatcatgcgtcaagcctccccagccacggacttgtctccatccagggcatttcagcccctgcagggcagtggcctgcccctcctccttggagccaggaagggatgcagtgccacagggatctggctctgtcccaggccctgtggggctggcagttgagtaagcagtcaggctgggcgcaccgcatccctcccccactccccactgcccagcacagtgcattcatgcagctgggccccaccccatctccagaggcaccttccactagcaacagtctccccaggcacaacacagctaacacaaggccccgcaggcaggactctgggacagacgcaggccagctgcccagagcccagaccaagcatggacgccgtggatgccaccatggagaaactccgggcacagtgcctgtcccgcggggcctcgggcatccagggcctggccaggtttttccgccaactagaccgggacgggagcagatccctggacgctgatgagttccggcagggtctggccaaactcgggctggtgctggaccaggcggaggcagagggtgtgtgcaggaagtgggaccgcaatggcagcgggacgctggatctggaggagttccttcgggcgctgcggccccccatgtcccaggcccgggaggctgtcatcgcagctgcatttgccaagctggaccgcagtggggacggcgtcgtgacggtggacgacctccgcggggtgtacagtggccgtgcccaccccaaggtgcgcagtggggagtggaccgaggacgaggtgctgcgccgcttcctggacaacttcgactcctctgagaaggacgggcaggtcacactggcggaattccagggactactacagcggcgtgagtgcctccatgaacacggatgaggagttcgtggccatgatgaccagtgcctggcagctgtgagcagctccggctcagccctgctgccctggcctgtcactccccacccctgccggagacctcccttccctgggccccttctctcctgggcagccacaccacagagcggggaggggcaggtgggggaatggaggctgcaggactggctagaccaggtccctgccggtccaccaggcggaggtgggacaaaggtcctaacaggagtcactggctcaggaccccagggagaaacgctctccccacccacgccatgctgaccagaggtcttgcagcccctgtggatgcccccgccgaggtcccccgatccccgcacccggactgctgctccctgcccctcccttgcgggtcccccaggaagccaggtgaccccaggtgggaggctgtgtgtggaggccatcctggaaggaagtttagacctgcccaggtgtggagcgaggggcacaggggcatcctaacctcagaaactgaaataaagcctttgaaaaaaaaatctgtaaaacatcaacccccaatcagaagatggcaaatggggaataaaaatagcaggtaacacgtccagcgggcccagtatctacattctggtgagcggcccgaggctgggagctctgggcgggggcagaccggcggggccttgcagcaggggtgggggtaaagtgcgggtggtggtggagagaacagggctgtggctggaccccagcactggtgacacgctgggtgggagcatgaggccccaggctgctggaggtcctcgcccggggaggtggaggccgttcctggtcaggggcttcctgaggcccctggggcatgcagaggccagggttttagttaaaagtttaatgtagttcccaaatacatttcatatgacaatcttacataaatgttccaaaacacaaaaa

SEQ ID NO: 288190 - DNA, 2116 bp, Homo sapiens
catgttggtcaggctggtctcaaactcctcaccttgtgatctgcccacctcggcctcccaaagtgctgggattacaggcatgagccaccgcgcccagcccacctggggcatttttgttgctgtacaatagaaacaagttctctatatgttccccaggctggtccaaactcctgggctcaagtgatcctcccacctagacctcccaaagtgctgggatttcaggcatgagccgcagtggccggtcagaacctggggcccttttgaactttgattcctcagcaattttgtcagccctggctcgggctgagaagcccctgtgaagccagagagggaaagggacctgtccagggtcacacaggaatcatgcgtcaagcctccccagccacggacttgtctccatccagggcatttcagcccctgcagggcagtggcctgcccctcctccttggagccaggaagggatgcagtgccacagggatctggctctgtcccaggccctgtggggctggcagttgagtaagcagtcaggctgggcgcaccgcatccctcccccactccccactgcccagcacagtgcattcatgcagctgggccccaccccatctccagaggcaccttccactagcaacagtctccccaggcacaacacagctaacacaaggccccgcaggcaggactctgggacagacgcaggccagctgcccagagcccagaccaagcatggacgccgtggatgccaccatggagaaactccgggcacagtgcctgtcccgcggggcctcgggcatccagggcctggccaggtgagctgtcccctctcaccttcctgaccccggcccctgagaccactgttccaaccgtgtcccctgcctccaggtttttccgccaactagaccgggacgggagcagatccctggacgctgatgagttccggcagggtctggccaaactcgggctggtgctggaccaggcggaggcagagggtgtgtgcaggaagtgggaccgcaatggcagcgggacgctggatctggaggagttccttcgggcgctgcgggtgagcccccacctcacagtcaaggcgtgtgccctgggcatggggcgacagaggatgctgagatgcggagacggggactcctccctaagagctgctgttaagaggcgcctgctggggcatacagccccagtgctctgcacagcgtcttgggggtttgggtgtgctacccaccacccccagtcaccacctcctgtcccagccccccatgtcccaggcccgggaggctgtcatcgcagctgcatttgccaagctggaccgcagtggggacggcgtcgtgacggtggacgacctccgcggggtgtacagtggccgtgcccaccccaaggtgcgcagtggggagtggaccgaggacgaggtgctgcgccgcttcctggacaacttcgactcctctgagaaggacgggcaggtcacactggcggaattccagggactactacagcggcgtgagtgcctccatgaacacggatgaggagttcgtggccatgatgaccagtgcctggcagctgtgagcagctccggctcagccctgctgccctggcctgtcactccccacccctgccggagacctcccttccctgggccccttctctcctgggcagccacaccacagagcggggaggggcaggtgggggaatggaggctgcaggactggctagaccaggtccctgccggtccaccaggcggaggtgggacaaaggtcctaacaggagtcactggctcaggaccccagggagaaacgctctccccacccacgccatgctgaccagaggtcttgcagcccctgtggatgcccccgccgaggtcccccgatccccgcacccggactgctgctccctgcccctcccttgcgggtcccccaggaagccaggtgaccccaggtgggaggctgtgtgtggaggccatcctggaaggaagtttagacctgcccaggtgtggagcgaggggcacaggggcatcctaacctcagaaactgaaataaagcctttgaaaaaaaaatctgtaaaacatcaacccccaatcagaagatggcaaatggggaataaaaatagcaggtaacacgtc

SEQ ID NO: 288191 - DNA, 1919 bp, Homo sapiens
catgttggtcaggctggtctcaaactcctcaccttgtgatctgcccacctcggcctcccaaagtgctgggattacaggcatgagccaccgcgcccagcccacctggggcatttttgttgctgtacaatagaaacaagttctctatatgttccccaggctggtccaaactcctgggctcaagtgatcctcccacctagacctcccaaagtgctgggatttcaggcatgagccgcagtggccggtcagaacctggggcccttttgaactttgattcctcagcaattttgtcagccctggctcgggctgagaagcccctgtgaagccagagagggaaagggacctgtccagggtcacacaggaatcatgcgtcaagcctccccagccacggacttgtctccatccagggcatttcagcccctgcagggcagtggcctgcccctcctccttggagccaggaagggatgcagtgccacagggatctggctctgtcccaggccctgtggggctggcagttgagtaagcagtcaggctgggcgcaccgcatccctcccccactccccactgcccagcacagtgcattcatgcagctgggccccaccccatctccagaggcaccttccactagcaacagtctccccaggcacaacacagctaacacaaggccccgcaggcaggactctgggacagacgcaggccaggtgagcatctgaacaaggggcagtcggccagggtgggcttgcgggagtccccaccttgacctctctcccttccagctgcccagagcccagaccaagcatggacgccgtggatgccaccatggagaaactccgggcacagtgcctgtcccgcggggcctcgggcatccagggcctggccaggtttttccgccaactagaccgggacgggagcagatccctggacgctgatgagttccggcagggtctggccaaactcgggctggtgctggaccaggcggaggcagagggtgtgtgcaggaagtgggaccgcaatggcagcgggacgctggatctggaggagttccttcgggcgctgcggccccccatgtcccaggcccgggaggctgtcatcgcagctgcatttgccaagctggaccgcagtggggacggcgtcgtgacggtggacgacctccgcggggtgtacagtggccgtgcccaccccaaggtgcgcagtggggagtggaccgaggacgaggtgctgcgccgcttcctggacaacttcgactcctctgagaaggacgggcaggtcacactggcggaattccagggactactacagcggcgtgagtgcctccatgaacacggatgaggagttcgtggccatgatgaccagtgcctggcagctgtgagcagctccggctcagccctgctgccctggcctgtcactccccacccctgccggagacctcccttccctgggccccttctctcctgggcagccacaccacagagcggggaggggcaggtgggggaatggaggctgcaggactggctagaccaggtccctgccggtccaccaggcggaggtgggacaaaggtcctaacaggagtcactggctcaggaccccagggagaaacgctctccccacccacgccatgctgaccagaggtcttgcagcccctgtggatgcccccgccgaggtcccccgatccccgcacccggactgctgctccctgcccctcccttgcgggtcccccaggaagccaggtgaccccaggtgggaggctgtgtgtggaggccatcctggaaggaagtttagacctgcccaggtgtggagcgaggggcacaggggcatcctaacctcagaaactgaaataaagcctttgaaaaaaaaatctgtaaaacatcaacccccaatcagaagatggcaaatggggaataaaaatagcaggtaacacgtc

SEQ ID NO: 288192 - DNA, 1763 bp, Homo sapiens
catgttggtcaggctggtctcaaactcctcaccttgtgatctgcccacctcggcctcccaaagtgctgggattacaggcatgagccaccgcgcccagcccacctggggcatttttgttgctgtacaatagaaacaagttctctatatgttccccaggctggtccaaactcctgggctcaagtgatcctcccacctagacctcccaaagtgctgggatttcaggcatgagccgcagtggccggtcagaacctggggcccttttgaactttgattcctcagcaattttgtcagccctggctcgggctgagaagcccctgtgaagccagagagggaaagggacctgtccagggtcacacaggaatcatgcgtcaagcctccccagccacggacttgtctccatccagggcatttcagcccctgcagggcagtggcctgcccctcctccttggagccaggaagggatgcagtgccacagggatctggctctgtcccaggccctgtggggctggcagttgagtaagcagtcaggctgggcgcaccgcatccctcccccactccccactgcccagcacagtgcattcatgcagctgggccccaccccatctccagaggcaccttccactagcaacagtctccccaggcacaacacagctaacacaaggccccgcaggcaggactctgggacagacgcaggccagctgcccagagcccagaccaagcatggacgccgtggatgccaccatggagaaactccgggcacagtgcctgtcccgcggggcctcgggcatccagggcctggccaggtttttccgccaactagaccgggacgggagcagatccctggacgctgatgagttccggcagggtctggccaaactcgggctggtgctggaccaggcggaggcagagggtgtgtgcaggaagtgggaccgcaatggcagcgggacgctggatctggaggagttccttcgggcgctgcggccccccatgtcccaggcccgggaggctgtcatcgcagctgcatttgccaagctggaccgcagtggggacggcgtcgtgacggtggacgacctccgcggggtgtacagtggccgtgcccaccccaaggtcacactggcggaattccagggactactacagcggcgtgagtgcctccatgaacacggatgaggagttcgtggccatgatgaccagtgcctggcagctgtgagcagctccggctcagccctgctgccctggcctgtcactccccacccctgccggagacctcccttccctgggccccttctctcctgggcagccacaccacagagcggggaggggcaggtgggggaatggaggctgcaggactggctagaccaggtccctgccggtccaccaggcggaggtgggacaaaggtcctaacaggagtcactggctcaggaccccagggagaaacgctctccccacccacgccatgctgaccagaggtcttgcagcccctgtggatgcccccgccgaggtcccccgatccccgcacccggactgctgctccctgcccctcccttgcgggtcccccaggaagccaggtgaccccaggtgggaggctgtgtgtggaggccatcctggaaggaagtttagacctgcccaggtgtggagcgaggggcacaggggcatcctaacctcagaaactgaaataaagcctttgaaaaaaaaatctgtaaaacatcaacccccaatcagaagatggcaaatggggaataaaaatagcaggtaacacgtc

SEQ ID NO: 288193 - DNA, 1338 bp, Homo sapiens
aggtgatccacccgcctcggccttcgaaagtgctgcagttataggtgtaagccaccgcgcccggccctagcctagcttttgtagcatgcaactgtctcctttttatacgccctaaagaatatatttttgaactccttgtttctgcgctgtccttcttagcccaggacattcagggtgctttgcttgttgtcaaaccagggaaaggagaaaactcctgtgcctttctgggccagcctgtcaccctggcctggtcggcagccattcccctacctcctcactcaggaactgtcacaccaggtttttccgccaactagaccgggacgggagcagatccctggacgctgatgagttccggcagggtctggccaaactcgggctggtgctggaccaggcggaggcagagggtgtgtgcaggaagtgggaccgcaatggcagcgggacgctggatctggaggagttccttcgggcgctgcggccccccatgtcccaggcccgggaggctgtcatcgcagctgcatttgccaagctggaccgcagtggggacggcgtcgtgacggtggacgacctccgcggggtgtacagtggccgtgcccaccccaaggtgcgcagtggggagtggaccgaggacgaggtgctgcgccgcttcctggacaacttcgactcctctgagaaggacgggcaggtcacactggcggaattccagggactactacagcggcgtgagtgcctccatgaacacggatgaggagttcgtggccatgatgaccagtgcctggcagctgtgagcagctccggctcagccctgctgccctggcctgtcactccccacccctgccggagacctcccttccctgggccccttctctcctgggcagccacaccacagagcggggaggggcaggtgggggaatggaggctgcaggactggctagaccaggtccctgccggtccaccaggcggaggtgggacaaaggtcctaacaggagtcactggctcaggaccccagggagaaacgctctccccacccacgccatgctgaccagaggtcttgcagcccctgtggatgcccccgccgaggtcccccgatccccgcacccggactgctgctccctgcccctcccttgcgggtcccccaggaagccaggtgaccccaggtgggaggctgtgtgtggaggccatcctggaaggaagtttagacctgcccaggtgtggagcgaggggcacaggggcatcctaacctcagaaactgaaataaagcctttgaaaaaaaaatctgtaaaacatcaacccccaatcagaagatggcaaatggggaataaaaatagcaggtaacacgtc

SEQ ID NO: 288194 - DNA, 3458 bp, Homo sapiens
cacacgaactgctcaaaggcttggagcgggtctagtaaggcgaacggactgcttccggccagaggtcccgggcggaggaggaagctgtggctgccggcggtgggacgccccggccgctcagcccccgggcactgctgtggggcgttcagctttccacacttggggcaaagcaagccgcgaggaggaaccagacagtcctgttagttgtggccagccctcattccctggaaatggcaaacaaggggaacaagaagcgtcggcagttctctctggaggagaaaatgaaagttgtgggagctgtagactcaggcaagaggaaaggtgatgtggcaaaagaatttggtatcactccctctactttatctacattcttaaaggatcgcaccaaatttgaagaaaaggtgcgggaggcatccgtgggaccccagcggaaaaggatgaggagcgctctttatgatgacattgataaggctgtttttgcttggtttcaagaaatccatgccaaaaacattcttgtgactggttctgtcattcggaaaaaagcactaaacttggccaacatgcttggctatgacaattttcaagcaagtgtgggctggctgaacagatttagagatcgccacggaattgctttgaaagcagtctgtagagaagatagtgacaggttaatgaatggtctaggaatagataagattaatgagtggcatgcaggggaaattataaaactgattgctgactacagcccagatgatatctttaatgctgatgagacaggagtgtttttccagttgcttccccagcacacacttgctgctaaaggagaccactgtagagggggcaagaaagcaaagcagcggttgacagcactcttttgttgcaatgcctcggggactgaaaaaatgagaccattgattgttggtaggtcagccagcccacactgcctcaagaacattcattccctcccttgtgattaccgagccaaccagtgggcttggatgacaagggatctgtttaatgagtggctgatgcaagtggatgccaggatgaagagggcggaacgccggatcctcttgctcatagacaactgctctgctcataacatgcttccacacttggaaaggattcaggttgggtatctgccctccaactgtactgctgtcctgcagccactgaatcttggcataattcacaccatgaaagtactgtaccagagccaccttctaaaacagatcctcctcaagctcaacagcagtgaggatcaagaagaggtggacatcaagcaggccatcgacatgattgctgcagcgtggtggtcagtcaagccatccacagtggtgaaatgttggcagaaggcaggcatcgtccctatggaatttgcagaatgtgacacagaatcagcagccagtgaaccagacattgccattgaaaagttgtggcacacagtggctattgccacctgtgtcccaaatgaagtaaatttccaggactttgttactgcagatgatgatctcattatctctcaggacacagacatcatccaggacatggtggctggcgaaaataccagtgaagcaggaagtgaagatgaaggggaggtatctttaccagagcaaccaaaagtcaccatcacagaagccatatcaagtgtacagaaacttagacagttcctttccacttgtgtagacattcctgatgccatttttggacaattaaatggcatagatgaatatttaatgaaaagagtgacacaaacccttattgattccaaaattacagatttcctccaaacaaaataatgcaggaatttatttcagaaaatgtagtttacaagaataaagatttctttagataggttgttgagccaatttaagtaaagcaatgttattgtgacaacattccagtactctgaaatagccaggaaacttctttgaatggaatttgactaatatgtgtgttttcttttcttttgtttttggctgtctctggtccttgattcaagatgtattttgattcatccaagggtttccaaacttgtctgcaaattaggatcacttgagaatcctttaaaaattccaaagctcaggccatatcccaggcctattaaatcacaatctttggtgacgggtcacaggcattggtagttttgaagctctccaggtgattccaatgtgcagacaaatttgaaaactgaaccaaccacaggaacatcaagtacactgtgggcctgggtccagcttctttccagtaagtgtatctcaggggcttccaaatttagcttacatcagaatcacttggaaggcttgttaaaacccaaggctgctaggcccacccccagagtttgatacagtagacctcaggtgggacccaaaaatttgcatttctaacacattctcagctgatgcagtccaggctccatgctttgaaaaccactggtctagctttagataggatattgagccaatttaaataaagcaatatactggtctagctgagttctagaacttctctctttagctggccatctgaatactcccccatcactaattgttaaaaaaagaatcaactgttcttactctagagctcttttttcctttctgctgatttgctggaagcactacaagacttctgtttgttcgttcgtttgtttgtttgtttgtttttaaagatggggtcttgttatattgcctaggctggaatgcagtggttattcacaggcatgattataacacactactctctctaactcctggcctcaagccatcctcccaaatagatgggactactgatgcacactgccatgctggccttacgaaatgttttaataggcatttcactaatagggatctggagtacaaggaaatacagtgcatttaagacataggctgggcatggtggctcatgcctgtaatcccagcacattgggaagatcacttgaggcaaggagtttgagaccagactggccaacacagcgagacccccatctctaaaaaaaaaaaaaattaataagacatggatacaaccagggagggaggttataataatagagcatcctgttaatcagaatcatgggggagaacatacagcccagcgtgcctctcactttccagaaagggtgagaggatcattagagagttcattagagagtatttattcctaataagtcagataaatgtcagtttcatttttagaagtttcacacaatacctgctaatggtgtgatgtcatttttccccctgcttcaggttaattttttggatatttcagaaacccatagcaattcagtgatttttctttttgtagtagctcagtcaaaacaggtaacagcagattaatcatagaaaatgttgcttccacattaacaaaacaatcactgaaaaacagcagatgtttaaatagattattttatagcttattttggatattttttcttttaataaactaatatgatcatttgaatc

SEQ ID NO: 288195 - DNA, 3820 bp, Homo sapiens
ctaggccccgcctcacctttcagagccacgtcgggcgctgggaagcctacaataccaccctctcctcagcacgacgttcaaggcctgacctcagcctgtctcagtctttccctctcattcaggatcgggttcatacgtagtgccgcatcaagtagcgccttcatcactccagtgatctgccctcaatccgtctctcccactggcccacgaatagtgatggtagtgagttcctggagtgactcaagctgagctgaatgaccgtatggagagcttccgtaaatcaaatagggattggattggattgtcctttctctccagtgtcacaagttgtccacatttgtacaagttcccgcacaaccctcactgtattccagtctgcctacttctctgcatctaccgccatcaccaaccttctagccaccatcatctcctgcctggactgatgtagttctccccacatcccctctacaatccattctccacgaagcagtcagattgatcattttgcactctttccacacttggggcaaagcaagccgcgaggaggaaccagacagtcctgttagttgtggccagccctcattccctggaaatggcaaacaaggggaacaagaagcgtcggcagttctctctggaggagaaaatgaaagttgtgggagctgtagactcaggcaagaggaaaggtgatgtggcaaaagaatttggtatcactccctctactttatctacattcttaaaggatcgcaccaaatttgaagaaaaggtgcgggaggcatccgtgggaccccagcggaaaaggatgaggagcgctctttatgatgacattgataaggctgtttttgcttggtttcaagaaatccatgccaaaaacattcttgtgactggttctgtcattcggaaaaaagcactaaacttggccaacatgcttggctatgacaattttcaagcaagtgtgggctggctgaacagatttagagatcgccacggaattgctttgaaagcagtctgtagagaagatagtgacaggttaatgaatggtctaggaatagataagattaatgagtggcatgcaggggaaattataaaactgattgctgactacagcccagatgatatctttaatgctgatgagacaggagtgtttttccagttgcttccccagcacacacttgctgctaaaggagaccactgtagagggggcaagaaagcaaagcagcggttgacagcactcttttgttgcaatgcctcggggactgaaaaaatgagaccattgattgttggtaggtcagccagcccacactgcctcaagaacattcattccctcccttgtgattaccgagccaaccagtgggcttggatgacaagggatctgtttaatgagtggctgatgcaagtggatgccaggatgaagagggcggaacgccggatcctcttgctcatagacaactgctctgctcataacatgcttccacacttggaaaggattcaggttgggtatctgccctccaactgtactgctgtcctgcagccactgaatcttggcataattcacaccatgaaagtactgtaccagagccaccttctaaaacagatcctcctcaagctcaacagcagtgaggatcaagaagaggtggacatcaagcaggccatcgacatgattgctgcagcgtggtggtcagtcaagccatccacagtggtgaaatgttggcagaaggcaggcatcgtccctatggaatttgcagaatgtgacacagaatcagcagccagtgaaccagacattgccattgaaaagttgtggcacacagtggctattgccacctgtgtcccaaatgaagtaaatttccaggactttgttactgcagatgatgatctcattatctctcaggacacagacatcatccaggacatggtggctggcgaaaataccagtgaagcaggaagtgaagatgaaggggaggtatctttaccagagcaaccaaaagtcaccatcacagaagccatatcaagtgtacagaaacttagacagttcctttccacttgtgtagacattcctgatgccatttttggacaattaaatggcatagatgaatatttaatgaaaagagtgacacaaacccttattgattccaaaattacagatttcctccaaacaaaataatgcaggaatttatttcagaaaatgtagtttacaagaataaagatttctttagataggttgttgagccaatttaagtaaagcaatgttattgtgacaacattccagtactctgaaatagccaggaaacttctttgaatggaatttgactaatatgtgtgttttcttttcttttgtttttggctgtctctggtccttgattcaagatgtattttgattcatccaagggtttccaaacttgtctgcaaattaggatcacttgagaatcctttaaaaattccaaagctcaggccatatcccaggcctattaaatcacaatctttggtgacgggtcacaggcattggtagttttgaagctctccaggtgattccaatgtgcagacaaatttgaaaactgaaccaaccacaggaacatcaagtacactgtgggcctgggtccagcttctttccagtaagtgtatctcaggggcttccaaatttagcttacatcagaatcacttggaaggcttgttaaaacccaaggctgctaggcccacccccagagtttgatacagtagacctcaggtgggacccaaaaatttgcatttctaacacattctcagctgatgcagtccaggctccatgctttgaaaaccactggtctagctttagataggatattgagccaatttaaataaagcaatatactggtctagctgagttctagaacttctctctttagctggccatctgaatactcccccatcactaattgttaaaaaaagaatcaactgttcttactctagagctcttttttcctttctgctgatttgctggaagcactacaagacttctgtttgttcgttcgtttgtttgtttgtttgtttttaaagatggggtcttgttatattgcctaggctggaatgcagtggttattcacaggcatgattataacacactactctctctaactcctggcctcaagccatcctcccaaatagatgggactactgatgcacactgccatgctggccttacgaaatgttttaataggcatttcactaatagggatctggagtacaaggaaatacagtgcatttaagacataggctgggcatggtggctcatgcctgtaatcccagcacattgggaagatcacttgaggcaaggagtttgagaccagactggccaacacagcgagacccccatctctaaaaaaaaaaaaaattaataagacatggatacaaccagggagggaggttataataatagagcatcctgttaatcagaatcatgggggagaacatacagcccagcgtgcctctcactttccagaaagggtgagaggatcattagagagttcattagagagtatttattcctaataagtcagataaatgtcagtttcatttttagaagtttcacacaatacctgctaatggtgtgatgtcatttttccccctgcttcaggttaattttttggatatttcagaaacccatagcaattcagtgatttttctttttgtagtagctcagtcaaaacaggtaacagcagattaatcatagaaaatgttgcttccacattaacaaaacaatcactgaaaaacagcagatgtttaaatagattattttatagcttattttggatattttttcttttaataaactaatatgatcatttgaatc

SEQ ID NO: 288196 - DNA, 184 bp, Homo sapiens
aaccttctagccaccatcatctcctgcctggactgatgtagttctccccacatcccctctacaatccattctccacgaagcagtcagattgatcattttgcactgtaagtctgatcaagtcactccctgcttaaaaccctccagtgtctcattcacttaaaataaaattcagacgtcttagctt

SEQ ID NO: 288197 - DNA, 528 bp, Homo sapiens
tgcggccgcgcctgcctgccccacctcgtaagggcctgtgacctcacgaggccagccgccgggcgctgcattcgagcggtggggctcctgtccgtgcgctttcctcccgcagccccggccgggattccgccctccgtccttgccacccgctcgccactcttccctaatcgctgttcattctccggtgcgctgtcccgccatggtctgaccccacttcaatcttaccttcggtccgtcctttgaacaccccgacccccgacccctttcttccaaaacattccatccttcttggcttctgctactcaataatggacagcagctcgaaggccatgtgtcccacggctttgctgaaatttgtctcgggttgcctttaaggagactgtcgtttccttttgaaagagatactttggttggtttggttttcttctgtgtgtttgtttttcctatgtatttatcgtatgcagttgggcaaaatacttaacgctccctgagtctcgattttctcattcttccagggttgtgggaatt

SEQ ID NO: 288198 - DNA, 713 bp, Homo sapiens
tgcggccgcgcctgcctgccccacctcgtaagggcctgtgacctcacgaggccagccgccgggcgctgcattcgagcggtggggctcctgtccgtgcgctttcctcccgcagccccggccgggattccgccctccgtccttgccacccgctcgccactcttccctaatcgctgttcattctccggtgcgctgtcccgccatggtctgaccccacttcaatcttaccttcgaacttcagattgaaaagcatgtacttgagtagctgtatttaaggaattacacccaagaagtctcatcttccctggacttacgtagaggataagattctgaactttgaattgatgctataatgggataagactttggggccttagaaggggagaacaaaggccatgaaggtgttaaagggaagcaagcgatcgacagcattggttggtgacaaacctgtggctggtctgtgtatgatgggatggattcctcctgctcccagaaggcactgtactttcagtgttcagggcagccttgccttagtgcctcaaacctatccctacatcctgcagtaaacttggaaaggtaacacctctaaccatcaggccttcctctgaagcacagtcaagttgctcttggcaaccatctcaattttaatagtgcagatgccatgtgctgtaaagtcctaaaatttaaattctttatttcttgacatcattgcctca

SEQ ID NO: 288199 - DNA, 547 bp, Homo sapiens
taatgacattttttgcattcttagagaccaggacctgccagccaagacaatattttgggttctttcccaaaatacttagtcatctaaaatcataaccctattgaaagctgccttcctgttcaaccccagtcaacaactaaaacagaggcatgtcacccctctgggggtcaggctgagtatactctgcagagctctgcttcccacaaatgtcaggagaacaaaggccatgaaggtgttaaagggaagcaagcgatcgacagcattggttggtgacaaacctgtggctggtctgtgtatgatgggatggattcctcctgctcccagaaggcactgtactttcagtgttcagggcagccttgccttagtgcctcaaacctatccctacatcctgcagtaaacttggaaaggtaacacctctaaccatcaggccttcctctgaagcacagtcaagttgctcttggcaaccatctcaattttaatagtgcagatgccatgtgctgtaaagtcctaaaatttaaattctttatttcttgacatcattgcctca

SEQ ID NO: 288200 - DNA, 1465 bp, Homo sapiens
ctagtagctttccctctatgttttcttctagtagttccagtcttacaggtaagtctttaatccattttgacttttgtatacggtgtgagataagggtccaatttcatttttctacacatggatatatggtttcccaacagtttttatcaaagagattcctttccccattgagtgttcttggctccttatcaaaattcaattgtctgtaaattctggactctctagtatgttctattggccaatgcatctgtttttatggaataccatgctgttttgattactgtaactttgtcgtttattttaaagtcagggactgtgatgccttcaactttgttttttttttgcttttttttttttgagatggattctggctctgtctctcaggctggagtatggctcacaggtcctctcattcaaacaatagggcttctaagaaacttaaggtcttgtccttcagcagaagcccaaggtagaaaaagacatatctcaaaggtatttgctgccatggcttttgtctcctggactaaaacccagtaagattcacagtagattcaaaaattgttttaagagaattgtattgtcagaaatactgtcagcttgagctgaaaaagagtacaaaaaggaaaggggcctttggaccctttctacaaacgcatttctacaaacaggaagcaggctaagaaaactatttaggtccaaacacatctccctttcacacaaaaaaggatgacttagaggataaaaccaagagcccagaaggtggaaccaaaagccatagggagttattcccaggctttgagtgtagaactgcaaacctgtactcaaatggatttcagaattgctatgaaccagtgacttctgtgcaccttggtttccacctgttggaacaggagtgtctatagcagttatctccctgcccctgctgttttacattggttgctgtggggaaaggagcatatgacctttttctttttgttcgcagaacttcagattgaaaagcatgtacttgagtagctgtatttaaggaattacacccaagaagtctcatcttccctggacttacgtagaggataagattctgaactttgaattgatgctataatgggataagactttggggccttagaaggggagaacaaaggccatgaaggtgttaaagggaagcaagcgatcgacagcattggttggtgacaaacctgtggctggtctgtgtatgatgggatggattcctcctgctcccagaaggcactgtactttcagtgttcagggcagccttgccttagtgcctcaaacctatccctacatcctgcagtaaacttggaaaggtaacacctctaaccatcaggccttcctctgaagcacagtcaagttgctcttggcaaccatctcaattttaatagtgcagatgccatgtgctgtaaagtcctaaaatttaaattctttatttcttgacatcattgcctca

SEQ ID NO: 288201 - DNA, 545 bp, Homo sapiens
ggttaaatatagacaagaattattggaaaggcgtttgatggagaaaaaggaagtggcccttcaagaagctcatgaagacaaagagagagcacggcggctagaagcccttaggaaacaggttgctgttgttgctcaatttgatcctgttagaatgatgtcagatacaatggcatcaaaagctagaatgggcattgaaattgaagaagaatttattcttcaaaagccactcttcacattgaatacatacaatgaacagcagataatttctgaccctagacttcgcttcgagttagcacttcgagaagctggacttcatagaacactttatgctaaagagatattaccaaaaattagtcctcaaaaacctccaagaaaggacatggagtctactgtatttaaaatatagagctcatcctcaaattctatatgtaaagagcatttttctttgaaaacatgtatatggataataataattactactttctaaaatgtttgaaatatcagacatagaaatcatagcatctattaaaacaactttgcctttc

SEQ ID NO: 288202 - DNA, 782 bp, Homo sapiens
  misc_feature (776)..(776): n is a, c, g, or t
ggttaaatatagacaagaattattggaaaggcgtttgatggagaaaaaggaagtggcccttcaagaagctcatgaagacaaagagagagcacggcggctagaagcccttaggaaacaggttgctgttgttgctcaatttgatcctgttagaatgatgtcagatacaatggcatcaaaagctagaatgggcattgaaattgaagaagaatttattcttcaaaagccactcttcacattgaatacatacaatgaacagcagataatttctgaccctagacttcgcttcgagttagcacttcgagaagctggacttcatagaacactttatgctaaagagatattaccaaaaattagtcctcaaaaacctccaagaaaggacatggagtctactgtatttaaaatatagagctcatcctcaaattctatatgtaaagagcatttttctttgaaaacatgtatatggataataataattactactttctaaaatgtttgaaatatcagacatagaaatcatagcatctattaaaacaactttgcctttcttttgtgattcttagaattttatgcactatatttcctgtatctttaagttatatttaatagtactaaattcccccaaattatggaacttaattatggcacatatagtacttatactataatttagtaaactacatgttggaggttatgttatcctataaaaagagctcaaaataactttgtgagaattataaattatgtagctgctcaaaaacaaaaacaagaaggcggtncggcgc

SEQ ID NO: 288203 - DNA, 5959 bp, Homo sapiens
  misc_feature (1)..(1): n is a, c, g, or t
  misc_feature (4)..(4): n is a, c, g, or t
  misc_feature (10)..(10): n is a, c, g, or t
  misc_feature (14)..(14): n is a, c, g, or t
  misc_feature (16)..(16): n is a, c, g, or t
  misc_feature (18)..(18): n is a, c, g, or t
  misc_feature (494)..(494): n is a, c, g, or t
  misc_feature (885)..(885): n is a, c, g, or t
  misc_feature (2884)..(2884): n is a, c, g, or t
  misc_feature (2940)..(2940): n is a, c, g, or t
ntcncttacntctngncnggattggaggagccatacccactgtgttctcgtactttgctgaagtcctggcccgggaaaagcggggcgaacacttgagctggctctgcatgttctggatgatcggtggcatctacgcctctgccatggcctgggccatcatcccgcactacgggtggagcttcagcatgggatcggcctaccagtttcacagttggcgtgtgtttgtcatcgtctgtgcactcccctgtgtctcctccgtggtggccctcacattcatgcctgaaagcccacgattcttgttggaggttggaaaacatgatgaagcttggatgattctgaagttaattcatgacaccaacatgagagcccggggtcagcctgagaaggtcttcacggtaaacaaaataaaaactcctaaacaaatagatgagctgattgaaattgagagtgacacaggaacatggtataggaggtgttttgttcggatccgcacngagctgtacggaatttggttgacttttatgagatgtttcaactacccagtcagggataatacaataaagcttacaattgtttggttcaccctgtcctttgggtactatggattatccgtttggttccctgatgtcattaaacctctgcagtccgatgaatatgcattgctaaccagaaatgtggagagagataaatatgcaaatttcagtattaactttacaatggaaaatcagattcatactggaatggaatacgacaatggcagattcataggggtcaagttcaaatctgtaactttcaaagactctgtttttaagtcctgcacctttgaggatgtaacttcagtgaacacctacttcaagaactgcacatttattgacactgtttttnacaacacagattttgagccatataaattcattgacagtgaatttaaaaactgctcgttttttcacaacaagacgggatgtcagattacctttgatgatgactatagtgcctactggatttattttgtcaactttctggggacattggcagtattgccagggaacattgtgtctgctctgctgatggacagaattgggcgcttaacaatgctaggtggctctatggtgctttcggggatcagctgtttcttcctttggttcggcaccagtgaatccatgatgataggcatgctgtgtctgtacaatggattgaccatctcagcctggaactctcttgacgtggtcactgtggaactgtaccccacagaccggagggcaacaggctttggcttcttaaatgcgctatgcaaggcagcagccgtcctgggaaacttaatatttggctctctggtcagcatcaccaaatcaatccccatcctgctggcttctactgtgctcgtgtgtggaggactcgttgggctgtgcctgcctgacacacgaacccaggttctgatgtaatgggaaaaaaagccatccttcctgcgtttcttcctcctgccctgggtcaattctccttcctgactcaaggcttcagagttttcctatatagaaaggtgatcaagtatcagaacataaacacgtgctgtgacttaaaatttagaagcatatcatcttgcccctttgtgattttgcacaggttgtttgtttgttttgttttgtttgaatgcattgttatctttccaaactgtgatgctactgcctcccgcaaatcagtggaagcatttctaaaatgccctaggcagccaggcttccctggggttctgctcattgaaagtttagaagctaagaagactgggctggtgtaagaaatagatcctgctcctaatttaacattaacaggaaatataagtcggcacattattgcatttgtgctgagaagagggattctttttttttttttttctaacagagtgatatttcctgtttacttagaaaaggacacccagtaattctcactgttatagcagagcctttcaaagaaaaccatgtggcaccaaacagggctgggtggggctctttggggcaagacaattaaggtgaccgctgacaagaaaaataaaagctctgcaattagcagcaaaaatctgagtgtgctgcataagcaagatttctgtcagaaagcccaattaaacctctgaaaagtgtgaggaaaaagaactgtaacagtatctgtgactgtggcatgtggttcagaatgtttgaaaatcagagatccgagagagagcttctgcctccatttaccactcccactccttcagctgcccttggtcttgccagacagcagattcagggaaagaaagctgcttcttaaaaactgtctgcctacctgattctgccacttacccacactgtctctagtctagagattgccagtggatagctaaattgtaaattgcaaattaggaagaaattcacacccagagccatttggaaatacaaaatggtacctctttccagtacctctttgctgtgggactggcccgccaggacccccaccccacctggcccgcagttgacattcagcttcccagctggcatcagcaaagagggtttgtccctctagcttccccagggctggcccactgctcaatgcgctcctggctccctgtaaaatcacagcccgcctgcactcctgagggcccctctcacagacagaccatctccctgtggttgtttgactgctcattttacctctggaatctgcctgggcttggaagaaagaggtcagccaggacattcccacgggcccgctgtcagctacatgaccttctcgcctctcaggctccccttcccccaggctcgtcctttttacacctcttctttgaaatctgaaccttccttgtagacttgcagccaatgaccagaagccaggaataaatcccatatttaaacaatattcnttttttaactgcctcgatagaggtttattcttgttacttattataggcattttcangcaagccatagcttggggcctccaggaagggaaagcttttgtttccactgatcattattttcagagatgtcctaactcccctgaggcccccctgcctccccctccccttcctaatgatccctcgcagagctcagactaagtgaaaagcttctttcattaacataagccattaatcgacttccccttgaagtaattcaggtctgcagaggggggaagactggtgttgggggcagtgggaagagggtggttccctgggggtctgtgatcagggctagaacatcaggaaaacccgaaccaaaaactgcaaaggtggcaggaagaagaaaaatcactgaaggctagacaagatgcatttgaaagataccaaccgcacagggaaagaaacaactttctctcacttctgcctcctatcattttattggagaacaaagacagcagtcaaacaacccaagaaagtaccctgtatgtttttcttcttccacatgtacccattttcccacctatctctccctgatttgtcttctttaaaaagacatttggggacctgagcaggtcttttagttgaatgcagcatgtgcagaaataactgcaaaagccaggagtgcatctccatcaacccatcaaaagaaaaatagaaatgtacatgggcatcgctgtctctagtcctctgtgatagttcactttgctaactagactacctttacttttcaaaatatctctaatgtctgctctggggtctaaatgcataaaacatctcccaagctgcagagcacagttattcagaattttatttgaacactgggttgggtcagcataggataaaccagcaaaaccttacttcatgagacctgccatccgtgtcccctgcagaaggaccgttcttggcctacttgttacctaatccgagcatccttggtggcctaagagggatcttttctcatctcctggacagtctgtggtcacaaaccttcttggtcaccacctctcccaccttttgtgcactcttccctgcctccttgagactgttcatcaccttgattttctaagagagctcaaatcatttccaaagcatgtggtgtggcctgtatagcttgctccagatttagctggagattaagaaacagccaggatattaaacagaaactctcagttgtatcagtgtagcaggccactggcacctaaacacgcaactggcatctcatttcgcctacagtagaaggaaaatgaaaatttgtacaaaaatgaaaacctaggaaatagtccacttgctcctatatttttaccaccttttctaactaaaatttccctgttgctctttggaatcaatccagaatgctcccaagtcccattattatcacagaatcttctcagtagggaaaaacaaacaactgcttcaaactgtgaattctgtatgtaccacattctatcccaggtattgggttttaaggcacccaactcacattcagtcctgctgcctgaatcatctcacaccagagtacagaccttggagacgcgatagatgggtcctagcctgaccttcaccactaagcggtacagggacccagatcttgctgtggagactgtaagtcgttgaacatctctagttctcactttccccgtgcacaaaataaaggattgggactagtctgctctccactctccagcattgtagaagacagtaatgaaaatagcttcatcttatctgccttcttatgctaaactcattttttttttttttaggtggagtttcactctgttgcccaggctggagtgcagtggtgggaactctgctcactgcaacctccgcctcccaggttcaagtgattctcccacctcagcctcccaagtagctgggaccacacgcatgcgccaccacgcccagctaatttttgtatcttttagtagaggtggggtttcaccgtgttggtcaggctggtctcgaactcctgacctcaagtgatcggcccacctcagcctcccaaaatgctgggattacaggcgtgagccactggcggcctcaactcatttttacaagcactaaataggtttagtttataaactgaaaaattaggaaataggcacgcataaaaagagtgtaggaagttgtttgggaagcccgcatggaataggccagaaagcacagtccccatgctgtctgccctgccagcatctcagcatcctgactagtatctctgttcactgcaggtttgacagttaccatcacccagccagaaaagggccccgccttgccagataaacgcgcttaggttagaagactataattgcaatattaccctacagctctcctgactgtttattccattattttcttgaaacatggccttaagtattatacataggcttcagaaacagtttttcagtgattttacctatattggcaaatagacaaatctcaccaaatcagagttcaggttttcaccaaaaactgcttagttgtctttcaagataccttaagagatcaaaggggaggtgggaaaagaaatgtagtgacagaagggagagtccaagataccactgataaggttccagcaaagagattaggacacagcagagactttctaaatgctggggtcatttccaaagcagtccaggggaatactttctgattccctctgccaatcaaaatagatagaatatgatattctccaattttttttctgtttgatgtcaaaatggcctttacctatttcttcagtaatatacctgatctgttcatgcactaaaggctctggagccaggaatgtctgaatttggccttcacctggtatcacagaaagacaactgggatattggtgttaaggggcatatcggctgtatgttaggttttctttaatcctcacatcgtgccaaacttagtctggttactaagcctaaaaacaccagtattgcaacaacttctgaaactctgaagtggactatatgtttctcacagtttttgtttatgctcagcaaagtatgtattttaagtaaagcttctcttgttatctgtaatgtagac

SEQ ID NO: 288204 - DNA, 940 bp, Homo sapiens
  misc_feature (1)..(1): n is a, c, g, or t
  misc_feature (4)..(4): n is a, c, g, or t
  misc_feature (10)..(10): n is a, c, g, or t
  misc_feature (14)..(14): n is a, c, g, or t
  misc_feature (16)..(16): n is a, c, g, or t
  misc_feature (18)..(18): n is a, c, g, or t
  misc_feature (494)..(494): n is a, c, g, or t
ntcncttacntctngncnggattggaggagccatacccactgtgttctcgtactttgctgaagtcctggcccgggaaaagcggggcgaacacttgagctggctctgcatgttctggatgatcggtggcatctacgcctctgccatggcctgggccatcatcccgcactacgggtggagcttcagcatgggatcggcctaccagtttcacagttggcgtgtgtttgtcatcgtctgtgcactcccctgtgtctcctccgtggtggccctcacattcatgcctgaaagcccacgattcttgttggaggttggaaaacatgatgaagcttggatgattctgaagttaattcatgacaccaacatgagagcccggggtcagcctgagaaggtcttcacggtaaacaaaataaaaactcctaaacaaatagatgagctgattgaaattgagagtgacacaggaacatggtataggaggtgttttgttcggatccgcacngagctgtacggaatttggttgacttttatgagatgtttcaactacccagtcagggataatacaataaagcttacaattgtttggttcaccctgtcctttgggtactatggattatccgtttggttccctgatgtcattaaacctctgcagtccgatgaatatgcattgctaaccagaaatgtggagagagataaatatgcaaatttcagtattaactttacaatggaaaatcagattcatactggaatggaatacgacaatggcaggtctagaaacttgaaataatttaatttgctacctattcacaaaaacttatttcttcttagctttccctgcactgaaacaggcatagttttttgtttgtttgttttagtttgtacatttagtcattttcatgatgaatttcaatacttcttaataggctttaaataaaaggtacaaatgta

SEQ ID NO: 288205 - DNA, 1055 bp, Homo sapiens
attcaagcctgggccctggaaggaggggtggacagtcccctcccttccagtccagcatgggtctggggaagaggagcagctttgcctggaaggggcctcctaggagggggagcggtggtttctagctcaggctttaggatcagagagcagcagattcaaatcctgacggttttggtaaagtcaattcaatctctccaagactccgtttatttgatctgcgaagtggggataatggtatcacgtcgcagggttgtcaggcggagctggtaggggagctgccccccagagcagcatggatgccccgcgaagggacatggagttgctcagcaacagcctggctgcctacgcgcacatccgcgccaaccccgagagcttcggcctctacttcgtgctgggcgtctgcttcggcctgctgctcaccctctgcctgctcgtcatcagcatctcgtgggcgccccgcccgcggccccggggcccggctcagcgccgggacccccgcagcagcaccctggagcccgaggacgacgacgaggacgaggaggacacggtgactcggctgggccccgacgacacgctgccgggccccgagctgtccgcagagccggacgggcccctcaacgtcaacgtcttcacgtcggcggaggagctggagcgggcgcagcggctggaggagcgcgaacggatcctgcgggagatctggcgcaccgggcagccggacctgctgggcacaggcacgctggggcccagccccacggccacgggcaccctgggccgcatgcactattactgatgggccccggctcccgctgcaaggcgctcggggtaccggacctgcacatgagctcagagctaccccacaccttcggactgcctcggcccccacagctcccaggtgctactgggcgtggaccgccaccccctgagaggctcccttccccagtcctgccagaagaccccgggggcggggagggggcagcatgcagggtccccactccctctctggggtcgatgaagaggtgaagtgaccaaatgaaagaaagctgcattctcagtga

SEQ ID NO: 288206 - DNA, 808 bp, Homo sapiens
ctattaggctaggtacgaggctgggtttgaatcggccgaggcagcatggatgccccgcgaagggacatggagttgctcagcaacagcctggctgcctacgcgcacatccgcgccaaccccgagagcttcggcctctacttcgtgctgggcgtctgcttcggcctgctgctcaccctctgcctgctcgtcatcagcatctcgtgggcgccccgcccgcggccccggggcccggctcagcgccgggacccccgcagcagcaccctggagcccgaggacgacgacgaggacgaggaggacacggtgactcggctgggccccgacgacacgctgccgggccccgagctgtccgcagagccggacgggcccctcaacgtcaacgtcttcacgtcggcggaggagctggagcgggcgcagcggctggaggagcgcgaacggatcctgcgggagatctggcgcaccgggcagccggacctgctgggcacaggcacgctggggcccagccccacggccacgggcaccctgggccgcatgcactattactgatgggccccggctcccgctgcaaggcgctcggggtaccggacctgcacatgagctcagagctaccccacaccttcggactgcctcggcccccacagctcccaggtgctactgggcgtggaccgccaccccctgagaggctcccttccccagtcctgccagaagaccccgggggcggggagggggcagcatgcagggtccccactccctctctggggtcgatgaagaggtgaagtgaccaaatgaaagaaagctgcattctcagtga

SEQ ID NO: 288207 - DNA, 1749 bp, Homo sapiens
attcaagcctgggccctggaaggaggggtggacagtcccctcccttccagtccagcatgggtctggggaagaggagcagctttgcctggaaggggcctcctaggagggggagcggtggtttctagctcaggctttaggatcagagagcagcagattcaaatcctgacggttttggtaaagtcaattcaatctctccaagactccgtttatttgatctgcgaagtggggataatggtatcacgtcgcagggttgtcaggcggagtaagtgaaagaacctgtccaaggtttagcccttggcccgcacgcaggcagagctccagcctctctgttgttgctgttagtggcctgggggcgggtccctgccgcggcctccccggcggtttcctcggaggaaactttccgccggctggtccctcggtccgtgtcccgcccgtgctgccgcggcctgggagcccagcggggccggaggggcggcgggacccgagcgggcgggggcggccggacccagtgtatgcggccgcgggacgcgctggggccgggcagccgggaagcggggcgctgacggtgagtgggcctggccccgggccggtgggtccccgcggggcggccgggcgaggagagaggcagcttcccttcccggagcccgcctggggcgtggaggctcagcgtccctatcctccatcccgccccgggacggcggaaccgggcctcagctggggacctcaccagggggcggggcctcccgcggtccccggcgctgctcccaggactggaggggcgtccgcgcccgggagaggggttccccccgacagggccccgggccgccacgaagttagggaagcgctctctccagggtggaacctgggcccgcggctcccgggagaggagctgcccgcggaaggggtcggggtgggctccaggctgggagaaggatctgactttgctgacctcgcaggctggtaggggagctgccccccagagcagcatggatgccccgcgaagggacatggagttgctcagcaacagcctggctgcctacgcgcacatccgcgccaaccccgagagcttcggcctctacttcgtgctgggcgtctgcttcggcctgctgctcaccctctgcctgctcgtcatcagcatctcgtgggcgccccgcccgcggccccggggcccggctcagcgccgggacccccgcagcagcaccctggagcccgaggacgacgacgaggacgaggaggacacggtgactcggctgggccccgacgacacgctgccgggccccgagctgtccgcagagccggacgggcccctcaacgtcaacgtcttcacgtcggcggaggagctggagcgggcgcagcggctggaggagcgcgaacggatcctgcgggagatctggcgcaccgggcagccggacctgctgggcacaggcacgctggggcccagccccacggccacgggcaccctgggccgcatgcactattactgatgggccccggctcccgctgcaaggcgctcggggtaccggacctgcacatgagctcagagctaccccacaccttcggactgcctcggcccccacagctcccaggtgctactgggcgtggaccgccaccccctgagaggctcccttccccagtcctgccagaagaccccgggggcggggagggggcagcatgcagggtccccactccctctctggggtcgatgaagaggtgaagtgaccaaatgaaagaaagctgcattctcagtga

SEQ ID NO: 288208 - DNA, 1640 bp, Homo sapiens
attcaagcctgggccctggaaggaggggtggacagtcccctcccttccagtccagcatgggtctggggaagaggagcagctttgcctggaaggggcctcctaggagggggagcggtggtttctagctcaggctttaggatcagagagcagcagattcaaatcctgacggttttggtaaagtcaattcaatctctccaagactccgtttatttgatctgcgaagtggggataatggtatcacgtcgcagggttgtcaggcggagtaagtgaaagaacctgtccaaggtttagcccttggcccgcacgcaggcagagctccagcctctctgttgttgctgttagtggcctgggggcgggtccctgccgcggcctccccggcggtttcctgtgggggacggacggcccgcgggccgggctctccctcctcccggctgcccgctcctctccccttcctctcccagcccttttcctccccgcctccccgcccgccccgccccgccccgtccctcctctttcctcggaggaaactttccgccggctggtccctcggtccgtgtcccgcccgtgctgccgcggcctgggagcccagcggggccggaggggcggcgggacccgagcgggcgggggcggccggacccagtgtatgcggccgcgggacgcgctggggccgggcagccgggaagcggggcgctgacggtgagtgggcctggccccgggccggtgggtccccgcggggcggccgggcgaggagagaggcagcttcccttcccggagcccgcctggggcgtggaggctcagcgtccctatcctccatcccgccccgggacggcggaaccgggcctcagctggggacctcaccagggggcggggcctcccgcggtccccggcgctgctcccaggactggaggggcgtccgcgcccgggagaggggttccccccgacagggccccgggccgccacgaagttagggaagcgctctctccagggtggaacctgggcccgcggctcccgggagaggagctgcccgcggaaggggtcggggtgggctccaggctgggagaaggatctgactttgctgacctcgcaggctggtaggggagctgccccccagagcagcatggatgccccgcgaagggacatggagttgctcagcaacagcctggctgcctacgcgcacatccgcgccaaccccgagagcttcggcctctacttcgtgctgggcgtctgcttcggcctgctgctcaccctctgcctgctcgtcatcagcatctcgtgggcgccccgcccgcggccccggggcccggctcagcgccgggacccccgcagcagcaccctggagcccgaggacgacgacgaggacgaggaggacacggtgactcggctgggccccgacgacacgctgccggggtaccggacctgcacatgagctcagagctaccccacaccttcggactgcctcggcccccacagctcccaggtgctactgggcgtggaccgccaccccctgagaggctcccttccccagtcctgccagaagaccccgggggcggggagggggcagcatgcagggtccccactccctctctggggtcgatgaagaggtgaagtgaccaaatgaaagaaagctgcattctcagtga

SEQ ID NO: 288209 - DNA, 1880 bp, Homo sapiens
attcaagcctgggccctggaaggaggggtggacagtcccctcccttccagtccagcatgggtctggggaagaggagcagctttgcctggaaggggcctcctaggagggggagcggtggtttctagctcaggctttaggatcagagagcagcagattcaaatcctgacggttttggtaaagtcaattcaatctctccaagactccgtttatttgatctgcgaagtggggataatggtatcacgtcgcagggttgtcaggcggagtaagtgaaagaacctgtccaaggtttagcccttggcccgcacgcaggcagagctccagcctctctgttgttgctgttagtggcctgggggcgggtccctgccgcggcctccccggcggtttcctgtgggggacggacggcccgcgggccgggctctccctcctcccggctgcccgctcctctccccttcctctcccagcccttttcctccccgcctccccgcccgccccgccccgccccgtccctcctctttcctcggaggaaactttccgccggctggtccctcggtccgtgtcccgcccgtgctgccgcggcctgggagcccagcggggccggaggggcggcgggacccgagcgggcgggggcggccggacccagtgtatgcggccgcgggacgcgctggggccgggcagccgggaagcggggcgctgacggtgagtgggcctggccccgggccggtgggtccccgcggggcggccgggcgaggagagaggcagcttcccttcccggagcccgcctggggcgtggaggctcagcgtccctatcctccatcccgccccgggacggcggaaccgggcctcagctggggacctcaccagggggcggggcctcccgcggtccccggcgctgctcccaggactggaggggcgtccgcgcccgggagaggggttccccccgacagggccccgggccgccacgaagttagggaagcgctctctccagggtggaacctgggcccgcggctcccgggagaggagctgcccgcggaaggggtcggggtgggctccaggctgggagaaggatctgactttgctgacctcgcaggctggtaggggagctgccccccagagcagcatggatgccccgcgaagggacatggagttgctcagcaacagcctggctgcctacgcgcacatccgcgccaaccccgagagcttcggcctctacttcgtgctgggcgtctgcttcggcctgctgctcaccctctgcctgctcgtcatcagcatctcgtgggcgccccgcccgcggccccggggcccggctcagcgccgggacccccgcagcagcaccctggagcccgaggacgacgacgaggacgaggaggacacggtgactcggctgggccccgacgacacgctgccgggccccgagctgtccgcagagccggacgggcccctcaacgtcaacgtcttcacgtcggcggaggagctggagcgggcgcagcggctggaggagcgcgaacggatcctgcgggagatctggcgcaccgggcagccggacctgctgggcacaggcacgctggggcccagccccacggccacgggcaccctgggccgcatgcactattactgatgggccccggctcccgctgcaaggcgctcggggtaccggacctgcacatgagctcagagctaccccacaccttcggactgcctcggcccccacagctcccaggtgctactgggcgtggaccgccaccccctgagaggctcccttccccagtcctgccagaagaccccgggggcggggagggggcagcatgcagggtccccactccctctctggggtcgatgaagaggtgaagtgaccaaatgaaagaaagctgcattctcagtga

SEQ ID NO: 288210 - DNA, 1489 bp, Homo sapiens
attcaagcctgggccctggaaggaggggtggacagtcccctcccttccagtccagcatgggtctggggaagaggagcagctttgcctggaaggggcctcctaggagggggagcggtggtttctagctcaggctttaggatcagagagcagcagattcaaatcctgacggttttggtaaagtcaattcaatctctccaagactccgtttatttgatctgcgaagtggggataatggtatcacgtcgcagggttgtcaggcggagtaagtgaaagaacctgtccaaggtttagcccttggcccgcacgcaggcagagctccagcctctctgttgttgctgttagtggcctgggggcgggtccctgccgcggcctccccggcggtttcctgtgggggacggacggcccgcgggccgggctctccctcctcccggctgcccgctcctctccccttcctctcccagcccttttcctccccgcctccccgcccgccccgccccgccccgtccctcctctttcctcggaggaaactttccgccggctggtccctcggtccgtgtcccgcccgtgctgccgcggcctgggagcccagcggggccggaggggcggcgggacccgagcgggcgggggcggccggacccagtgtatgcggccgcgggacgcgctggggccgggcagccgggaagcggggcgctgacggctggtaggggagctgccccccagagcagcatggatgccccgcgaagggacatggagttgctcagcaacagcctggctgcctacgcgcacatccgcgccaaccccgagagcttcggcctctacttcgtgctgggcgtctgcttcggcctgctgctcaccctctgcctgctcgtcatcagcatctcgtgggcgccccgcccgcggccccggggcccggctcagcgccgggacccccgcagcagcaccctggagcccgaggacgacgacgaggacgaggaggacacggtgactcggctgggccccgacgacacgctgccgggccccgagctgtccgcagagccggacgggcccctcaacgtcaacgtcttcacgtcggcggaggagctggagcgggcgcagcggctggaggagcgcgaacggatcctgcgggagatctggcgcaccgggcagccggacctgctgggcacaggcacgctggggcccagccccacggccacgggcaccctgggccgcatgcactattactgatgggccccggctcccgctgcaaggcgctcggggtaccggacctgcacatgagctcagagctaccccacaccttcggactgcctcggcccccacagctcccaggtgctactgggcgtggaccgccaccccctgagaggctcccttccccagtcctgccagaagaccccgggggcggggagggggcagcatgcagggtccccactccctctctggggtcgatgaagaggtgaagtgaccaaatgaaagaaagctgcattctcagtga

SEQ ID NO: 288211 - DNA, 653 bp, Homo sapiens
gccctccgggaagcggggcgctgacggctggtaggggagctgccccccagagcagcatggatgccccgcgaagggacatggagttgctcagcaacagcctggctgcctacgcgcacatccgcgccaaccccgagagcttcggcctctacttcgtgtgggccccgacgacacgctgccgggccccgagctgtccgcagagccggacgggcccctcaacgtcaacgtcttcacgtcggcggaggagctggagcgggcgcagcggctggaggagcgcgaacggatcctgcgggagatctggcgcaccgggcagccggacctgctgggcacaggcacgctggggcccagccccacggccacgggcaccctgggccgcatgcactattactgatgggccccggctcccgctgcaaggcgctcggggtaccggacctgcacatgagctcagagctaccccacaccttcggactgcctcggcccccacagctcccaggtgctactgggcgtggaccgccaccccctgagaggctcccttccccagtcctgccagaagaccccgggggcggggagggggcagcatgcagggtccccactccctctctggggtcgatgaagaggtgaagtgaccaaatgaaagaaagctgcattctcagtga

SEQ ID NO: 288212 - DNA, 345 bp, Homo sapiens
tagaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtattgatattatcatctgctgagggtggaagggcagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcaggggtcttgag

SEQ ID NO: 288213 - DNA, 486 bp, Homo sapiens
cggaatccgcagacgctcagcaggtatcttgatattatcatctgctgagggtggagctgagggtggaaggggagtgagctgacgctcggaaggtgtcttgagatcatccgctgagggtggaaggcaggtgtcttgatattatcatctgctgagggtggagctgagggtggaaggggagtgagctgacgctcggaaggtgtcttgagattatcatccgctgagggtggaaggggatggagcagacactcggcacgtgtcttgagattatcatccgctgagggtggagctgagggtagagctgagggtggaaggggagtgagtagacactcgggaggtgtcttgagattatcatccgctgagggtggaaggggagtgagcagacactcaggaggtgtcttgagattatcatccgctgagggtggaaggggagtgagcacacactcgggaggtgtcttgagattatcatccgctgagggtggaagggga

SEQ ID NO: 288214 - DNA, 650 bp, Homo sapiens
acccgcgaggcgggcccgcctccgcgtactcaccgggcctcccgggccgccggctcggccctcctctccctcctccccccgccgccgcctctcccgcggctccccaggcggccgcactgggcgttgggactggtctgggtcaagtgtcggcagagctgggggcaggctcgcgccgggcgggggtcgcggtcggcccacaggctgggcactaacgggtcccggggcgccggggcggactgcggcgcggcgctggcgctggttagaggttcgccggtgacgtgagcgcccgagttgggggagaggaccagaaccacctgctggagaaagggagctacgggggccgggcagggtccaaacgcctcacgtgggcggcggcgccacggtcttcggggtcacaggtcgtagtggactaattttacaggcgaagttaagtgacttacccaaaacctcacagctaataaacggcagagccggcacccagctgtactggcttccagcgcatcccattatctccataaatccccctgattcaactaatattagacgccccacagctggaccctggacacggtgactctgattcaattatgcagatgaccacaagcctctggggttggcagagccacaagaaagaaggtgcctggatgaag

SEQ ID NO: 288215 - DNA, 936 bp, Homo sapiens
agtcgctcccggctccgcggccgcggaggtgtggggacccgggcttgcgtcggagggggcggtgggctcacccatgggcctttccaaaagcaaagagaaacccaggaaaggtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaagagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaccccaccctgtgagaaactgcagcccccttctccagtgctttcggggagggtgcaccaggcccgccccaccttgtgagaagccgtggcccccttctccagtgctctcagggagggtgcaccaggcctgcccccgccgtgagaaactgcagtccccttctccagtgctctcggggagggtgcaccaggcccaccccaccctgtgagaacctgcagcccccttctccaatgctcttcggggagggtacaccagggttgccccaccctgtgagaagccaccgcccccttctccagtgctctcggggagggtgcaccagggct

SEQ ID NO: 288216 - DNA, 583 bp, Homo sapiens
tgtaatctgagtcagcttatgaaaaggccccaaagaagaaagtggaatgtgtgctgggcacatgggacagccatggcactgagactttggaagtggccttgccagcgctgtcctgtctttctggcccacagatgagggctcctgattgtggaaggccacggaagggacctgaacacgatggcacgagacaagttatctcctgtgactgctcctctccagcaaccctcagctcaggctagactttccccctgtgttgagaatgccctgccctgtgtggaagcctgatgcatttagtgacagtgtgttagctttgttagtttctagtctggccagcaggctttccatgtgatctgccattggcttgcttcagtggccagtggagccaggggtgtccaccagagtcttggacacagacttctgaggtggcagcgggagggagcctgctccctgccacacacgtacaatttctaatccatacaggcctatgtagtatatacacacatacgcagagccttaggaattgtgaaaggccaatcaaaacttggggccctaatttcactctgccaaaagaaaaaaaaaaaaa

SEQ ID NO: 288217 - DNA, 827 bp, Homo sapiens
agcgcaggcgccaggctcggcccggtgcgaaccgttcctgccgccgagtccgccacggacggcgcgtttcccgcctgaggcggttacggaaacgcggagactcgagacttgaagccagcttattctggacccacgcaggcgactgaagacgatgggacccactgccctgcattcgagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaccccaccctgtgagaaactgcagcccccttctccagtgctttcggggagggtgcaccaggcccgccccaccttgtgagaagccgtggcccccttctccagtgctctcagggagggtgcaccaggcctgcccccgccgtgagaaactgcagtccccttctccagtgctctcggggagggtgcaccaggcccaccccaccctgtgagaacctgcagcccccttctccaatgctcttcggggagggtacaccagggttgccccaccctgtgagaagccaccgcccccttctccagtgctctcggggagggtgcaccagggct

SEQ ID NO: 288218 - DNA, 1039 bp, Homo sapiens
agcgcaggcgccaggctcggcccggtgcgaaccgttcctgccgccgagtccgccacggacggcgcgtttcccgcctgaggcggttacggaaacgcggagactcgagacttgaagccagcttattctggacccacgcaggcgactgaagacgatgggacccactgccctgcattcggtaagtcccgggtctaacggatgatccatatatttcaggtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaagagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaccccaccctgtgagaaactgcagcccccttctccagtgctttcggggagggtgcaccaggcccgccccaccttgtgagaagccgtggcccccttctccagtgctctcagggagggtgcaccaggcctgcccccgccgtgagaaactgcagtccccttctccagtgctctcggggagggtgcaccaggcccaccccaccctgtgagaacctgcagcccccttctccaatgctcttcggggagggtacaccagggttgccccaccctgtgagaagccaccgcccccttctccagtgctctcggggagggtgcaccagggct

SEQ ID NO: 288219 - DNA, 1116 bp, Homo sapiens
agcgcaggcgccaggctcggcccggtgcgaaccgttcctgccgccgagtccgccacggacggcgcgtttcccgcctgaggcggttacggaaacgcggagactcgagacttgaagccagcttattctggacccacgcaggcgactgaagacgatgggacccactgccctgcattcggtaagtcccgggtctaacggatgatccatatatttcaggtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaaggtaggagacggcgggagggagcgaagcgaggtcagtggcttggaggatctggggctggggtgaggagcctactgtaagaccctaccggatggacactagtagcaggcacgcgccgtaaagatgaaactggtttgttttgggaactttatgtaggaggtaaatatccagaaatcttagttgaaaacataagtttaatgaaaatgtaggtcagttcccgagtgataagtgcgtaccaggtggtcgaggggctggggcagtgtgcgtgtgtctcacctgaggttctcctcgagggctgggtatcttggtgccactgagaatccctgagcctccgcacactggaacagagcattgggaggccgtcccaggctggactgtagctctccgagggctgtggggataagtacattgcggagggtgaccgaggagtagaacctgggtgcgacaaaggtgtcttttataacagcctagtgtggccagacctttgggtgtgtgtggggaagatgaggccccaaaagtaggaagaagctagaatacaaagttttccatcagttttaccacgtggagctggaagcgttaaatattttaaacaacggaggtgctgcctggggcggtagttcacacctgtcctcccagttatttggccgaggcaggaggatcttttgagcccaggagttcaagaccagcttgggcaacatagtgagaccctgtctctacaaaaaataaatattt

SEQ ID NO: 288220 - DNA, 1013 bp, Homo sapiens
agtcgctcccggctccgcggccgcggaggtgtggggacccgggcttgcgtcggagggggcggtgggctcacccatgggcctttccaaaagcaaagagaaacccaggaaaggtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaaggtaggagacggcgggagggagcgaagcgaggtcagtggcttggaggatctggggctggggtgaggagcctactgtaagaccctaccggatggacactagtagcaggcacgcgccgtaaagatgaaactggtttgttttgggaactttatgtaggaggtaaatatccagaaatcttagttgaaaacataagtttaatgaaaatgtaggtcagttcccgagtgataagtgcgtaccaggtggtcgaggggctggggcagtgtgcgtgtgtctcacctgaggttctcctcgagggctgggtatcttggtgccactgagaatccctgagcctccgcacactggaacagagcattgggaggccgtcccaggctggactgtagctctccgagggctgtggggataagtacattgcggagggtgaccgaggagtagaacctgggtgcgacaaaggtgtcttttataacagcctagtgtggccagacctttgggtgtgtgtggggaagatgaggccccaaaagtaggaagaagctagaatacaaagttttccatcagttttaccacgtggagctggaagcgttaaatattttaaacaacggaggtgctgcctggggcggtagttcacacctgtcctcccagttatttggccgaggcaggaggatcttttgagcccaggagttcaagaccagcttgggcaacatagtgagaccctgtctctacaaaaaataaatattt

SEQ ID NO: 288221 - DNA, 492 bp, Homo sapiens
agtcgctcccggctccgcggccgcggaggtgtggggacccgggcttgcgtcggagggggcggtgggctcacccatgggcctttccaaaagcaaagagaaacccaggaaaggtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaaggtaggagacggcgggagggagcgaagcgaggtcagtggcttggaggatctggggctggggtgaggagcctactgtaagaccctaccggatggacactagtagcaggcacgcgccgtaaagatgaaactggtttgttttgggaactttatgtaggagggctcagaacaggcacgcgataaaagccagcaccgttggccgggcgcattgg

SEQ ID NO: 288222 - DNA, 1078 bp, Homo sapiens
agtcgctcccggctccgcggccgcggaggtgtggggacccgggcttgcgtcggagggggcggtgggctcacccatgggcctttccaaaagcaaagagaaacccaggaaaggtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaagagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaccccaccctatgagggctcctgattgtggaaggccacggaagggacctgaacacgatggcacgagacaagttatctcctgtgactgctcctctccagcaaccctcagctcaggctagactttccccctgtgttgagaatgccctgccctgtgtggaagcctgatgcatttagtgacagtgtgttagctttgttagtttctagtctggccagcaggctttccatgtgatctgccattggcttgcttcagtggccagtggagccaggggtgtccaccagagtcttggacacagacttctgaggtggcagcgggagggagcctgctccctgccacacacgtacaatttctaatccatacaggcctatgtagtatatacacacatacgcagagccttaggaattgtgaaaggccaatcaaaacttggggccctaatttcactctgccaaaagaaaaaaaaaaaaa

SEQ ID NO: 288223 - DNA, 1423 bp, Homo sapiens
agtcgctcccggctccgcggccgcggaggtgtggggacccgggcttgcgtcggagggggcggtgggctcacccatgggcctttccaaaagcaaagagaaacccaggaaaggtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaagagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcaaaaaaaaaaaaaaaaaaaaaaaaaaaaatggtgctgggacgcgccgcggaccactaggaaaaaggtcttccaaaacacatccgttggggccgccggccccaagtgggcttaggtcgaacaggggcccaagactgggtgccaaggaagaaccgggccaggacctaggggcgcggcttcctccaccaaattaaaaaagcgcgcggggccaacaccggagggtctggacacacactcccagaagggagtccggaggcacaagcgggccccactccacggggggctcaaggagaagcccgagaatactaaaaatttaacgcgccccgccccggtggaaaaagaaacagagacaggagagaaaaaacagaaagcagacaagcacgaaaggacgaacaaagacacagacaaggaccagcgaacagacagaaaaacacaaaagcaacaaaaaacagacaaacagcaacggccatgaagcagaggaacaacagaaaacaaagagagacacagaacaacaaagcggcaagaaaagcaaaacgacgacagaacagagacacgaagacaacaagaaaagcgagagacaaacacaacagatagacaacggagacacaccaaaagcaccaacgaaacaaaagagacggagcaccaaacacaggagaacaaaacagaagaggagaaagacgccaaaaacagagagagaacggcaaaagacacagggagcaggagcagaaggggacgaggaagcacagccaaacacacaagaaaagaaaagaaaaagaaaagcacagagagcaagcagggaagagagaaaacacgagacaggaaaaaagagcacaaacgaaacaaacggagaagaagagaaggagaagaaagggaatagagaaaaaagaaggcagaggaacacaccgaagag

SEQ ID NO: 288224 - DNA, 2013 bp, Homo sapiens
agtcgctcccggctccgcggccgcggaggtgtggggacccgggcttgcgtcggagggggcggtgggctcacccatgggcctttccaaaagcaaagagaaacccaggaaaggtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaagtgacgggctgagcgacagtgaggagcaggctgctgactcccttgccacaccgtgaaggagtcccaaaggtgggacactgagtgagacaagccagaggaaagaccactcatgttgcagttccctttccatggaatgtccagaaaaggcacatttacagagagaagcagatgagtggttgctgggcagaaatgggagccggccacagctgagcacaagaggactttggagggtgatggaaatggttttcgacctgaatctgaacatgggaagcactgcagtttagtagtcctggtccctaagcccttccagcccaggagccagacctgtgagcaaacaagcctttagtgattccaggctctggctggaaccttgagtcttctcagcttggggcatgcacctcagggggagccagcatcagtgtccagccccaagagcttccctgtacgtctcagtgagtcttcacatgcctccaactgcctggacaaccacacgtgatacctgtcctgccaaacgtgtcctgaacccataaaatccagagaaaagaaaatcgttttaaactgctgaggtttggggtaagttactatgaagcagtagtgagaagaacagaagggccatgatggggagaaagtttggccataagttaatcactgtggcagctgttaggatattgatgtggcttggctgtgtcctcacccaaatctcattttgaattcccacatgtgggaggaactgggtgggaggtgattgaattatgggggcaggtctttcctgtgctgttttcgtgatagtgaatgagtgtcacgagatccgatggttttaaaaacgggagtttcctgcataagctctctctctgcctgctgccatccatgtaagatgtgactcgctcctccctaccttccgccgtgattgtgaggcgtccccagccatgtggaactagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaccccaccctatgagggctcctgattgtggaaggccacggaagggacctgaacacgatggcacgagacaagttatctcctgtgactgctcctctccagcaaccctcagctcaggctagactttccccctgtgttgagaatgccctgccctgtgtggaagcctgatgcatttagtgacagtgtgttagctttgttagtttctagtctggccagcaggctttccatgtgatctgccattggcttgcttcagtggccagtggagccaggggtgtccaccagagtcttggacacagacttctgaggtggcagcgggagggagcctgctccctgccacacacgtacaatttctaatccatacaggcctatgtagtatatacacacatacgcagagccttaggaattgtgaaaggccaatcaaaacttggggccctaatttcactctgccaaaagaaaaaaaaaaaaa

SEQ ID NO: 288225 - DNA, 969 bp, Homo sapiens
agcgcaggcgccaggctcggcccggtgcgaaccgttcctgccgccgagtccgccacggacggcgcgtttcccgcctgaggcggttacggaaacgcggagactcgagacttgaagccagcttattctggacccacgcaggcgactgaagacgatgggacccactgccctgcattcgagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaccccaccctatgagggctcctgattgtggaaggccacggaagggacctgaacacgatggcacgagacaagttatctcctgtgactgctcctctccagcaaccctcagctcaggctagactttccccctgtgttgagaatgccctgccctgtgtggaagcctgatgcatttagtgacagtgtgttagctttgttagtttctagtctggccagcaggctttccatgtgatctgccattggcttgcttcagtggccagtggagccaggggtgtccaccagagtcttggacacagacttctgaggtggcagcgggagggagcctgctccctgccacacacgtacaatttctaatccatacaggcctatgtagtatatacacacatacgcagagccttaggaattgtgaaaggccaatcaaaacttggggccctaatttcactctgccaaaagaaaaaaaaaaaaa

SEQ ID NO: 288226 - DNA, 1824 bp, Homo sapiens
agtcgctcccggctccgcggccgcggaggtgtggggacccgggcttgcgtcggagggggcggtgggctcacccatgggcctttccaaaagcaaagagaaacccaggaaaggtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaagtgacgggctgagcgacagtgaggagcaggctgctgactcccttgccacaccgtgaaggagtcccaaaggtgggacactgagtgagacaagccagaggaaagaccactcatgttgcagttccctttccatggaatgtccagaaaaggcacatttacagagagaagcagatgagtggttgctgggcagaaatgggagccggccacagctgagcacaagaggactttggagggtgatggaaatggttttcgacctgaatctgaacatgggaagcactgcagtttagtagtcctggtccctaagcccttccagcccaggagccagacctgtgagcaaacaagcctttagtgattccaggctctggctggaaccttgagtcttctcagcttggggcatgcacctcagggggagccagcatcagtgtccagccccaagagcttccctgtacgtctcagtgagtcttcacatgcctccaactgcctggacaaccacacgtgatacctgtcctgccaaacgtgtcctgaacccataaaatccagagaaaagaaaatcgttttaaactgctgaggtttggggtctttcctgtgctgttttcgtgatagtgaatgagtgtcacgagatccgatggttttaaaaacgggagtttcctgcataagctctctctctgcctgctgccatccatgtaagatgtgactcgctcctccctaccttccgccgtgattgtgaggcgtccccagccatgtggaactagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaccccaccctatgagggctcctgattgtggaaggccacggaagggacctgaacacgatggcacgagacaagttatctcctgtgactgctcctctccagcaaccctcagctcaggctagactttccccctgtgttgagaatgccctgccctgtgtggaagcctgatgcatttagtgacagtgtgttagctttgttagtttctagtctggccagcaggctttccatgtgatctgccattggcttgcttcagtggccagtggagccaggggtgtccaccagagtcttggacacagacttctgaggtggcagcgggagggagcctgctccctgccacacacgtacaatttctaatccatacaggcctatgtagtatatacacacatacgcagagccttaggaattgtgaaaggccaatcaaaacttggggccctaatttcactctgccaaaagaaaaaaaaaaaaa

SEQ ID NO: 288227 - DNA, 1225 bp, Homo sapiens
agtcgctcccggctccgcggccgcggaggtgtggggacccgggcttgcgtcggagggggcggtgggctcacccatgggcctttccaaaagcaaagagaaacccaggaaaggtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaagtgaatgagtgtcacgagatccgatggttttaaaaacgggagtttcctgcataagctctctctctgcctgctgccatccatgtaagatgtgactcgctcctccctaccttccgccgtgattgtgaggcgtccccagccatgtggaactagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaccccaccctatgagggctcctgattgtggaaggccacggaagggacctgaacacgatggcacgagacaagttatctcctgtgactgctcctctccagcaaccctcagctcaggctagactttccccctgtgttgagaatgccctgccctgtgtggaagcctgatgcatttagtgacagtgtgttagctttgttagtttctagtctggccagcaggctttccatgtgatctgccattggcttgcttcagtggccagtggagccaggggtgtccaccagagtcttggacacagacttctgaggtggcagcgggagggagcctgctccctgccacacacgtacaatttctaatccatacaggcctatgtagtatatacacacatacgcagagccttaggaattgtgaaaggccaatcaaaacttggggccctaatttcactctgccaaaagaaaaaaaaaaaaa

SEQ ID NO: 288228 - DNA, 1253 bp, Homo sapiens
agtcgctcccggctccgcggccgcggaggtgtggggacccgggcttgcgtcggagggggcggtgggctcacccatgggcctttccaaaagcaaagagaaacccaggaaaggtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaagtgacgggctgagcgacagtgaggagcaggctgctgactcccttgccacaccgtgaaggagtcccaaaggtgggacactgagtgagacaagccagaggaaagaccactcatgttgcagttccctttccatggaatgtccagaaaaggcacatttacagagagaagcagatgagtggttgctgggcagaaatgggagccggccacagctgagcacaagaggactttggagggtgatggaaatggttttcgacctgaatctgaacatgggaagcactgcagtttagtagtcctggtccctaagcccttccagcccaggagccagacctgtgagcaaacaagcctttagtgattccaggctctggctggaaccttgagtcttctcagcttggggcatgcacctcagggggagccagcatcagtgtccagccccaagagcttccctgtacgtctcagtgagtcttcacatgcctccaactgcctggacaaccacacgtgatacctgtcctgccaaacgtgtcctgaacccataaaatccagagaaaagaaaatcgttttaaactgctgaggtttggggtaagttactatgaagcagtagtgagaagaacagaagggccatgatggggagaaagtttggccataagttaatcactgtggcagctgttaggatattgatgtggcttggctgtgtcctcacccaaatctcattttgaattcccacatgtgggaggaactgggtgggaggtgattgaattatgggggcaggtctttcctgtgctgttttcgtgatagtgaatgagtgtcacgagatccgatggttttaaaaacgggagtttcctgcataagctctctctctgcctgctgccatccatgtaagatgtgactcgctcctccctaccttccgccgtgattgtgaggcgtccccagccatgtggaactgtaagtccattaaacctttttcctgtgtaaatta

SEQ ID NO: 288229 - DNA, 904 bp, Homo sapiens
agtcgctcccggctccgcggccgcggaggtgtggggacccgggcttgcgtcggagggggcggtgggctcacccatgggcctttccaaaagcaaagagaaacccaggaaagagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaccccaccctatgagggctcctgattgtggaaggccacggaagggacctgaacacgatggcacgagacaagttatctcctgtgactgctcctctccagcaaccctcagctcaggctagactttccccctgtgttgagaatgccctgccctgtgtggaagcctgatgcatttagtgacagtgtgttagctttgttagtttctagtctggccagcaggctttccatgtgatctgccattggcttgcttcagtggccagtggagccaggggtgtccaccagagtcttggacacagacttctgaggtggcagcgggagggagcctgctccctgccacacacgtacaatttctaatccatacaggcctatgtagtatatacacacatacgcagagccttaggaattgtgaaaggccaatcaaaacttggggccctaatttcactctgccaaaagaaaaaaaaaaaaa

SEQ ID NO: 288230 - DNA, 1064 bp, Homo sapiens
agtcgctcccggctccgcggccgcggaggtgtggggacccgggcttgcgtcggagggggcggtgggctcacccatgggcctttccaaaagcaaagagaaacccaggaaaggtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaagtgacgggctgagcgacagtgaggagcaggctgctgactcccttgccacaccgtgaaggagtcccaaaggtgggacactgagtgagacaagccagaggaaagaccactcatgttgcagttccctttccatggaatgtccagaaaaggcacatttacagagagaagcagatgagtggttgctgggcagaaatgggagccggccacagctgagcacaagaggactttggagggtgatggaaatggttttcgacctgaatctgaacatgggaagcactgcagtttagtagtcctggtccctaagcccttccagcccaggagccagacctgtgagcaaacaagcctttagtgattccaggctctggctggaaccttgagtcttctcagcttggggcatgcacctcagggggagccagcatcagtgtccagccccaagagcttccctgtacgtctcagtgagtcttcacatgcctccaactgcctggacaaccacacgtgatacctgtcctgccaaacgtgtcctgaacccataaaatccagagaaaagaaaatcgttttaaactgctgaggtttggggtctttcctgtgctgttttcgtgatagtgaatgagtgtcacgagatccgatggttttaaaaacgggagtttcctgcataagctctctctctgcctgctgccatccatgtaagatgtgactcgctcctccctaccttccgccgtgattgtgaggcgtccccagccatgtggaactgtaagtccattaaacctttttcctgtgtaaatta

SEQ ID NO: 288231 - DNA, 1212 bp, Homo sapiens
caggtgccagagttcgtatatgactccagtcctggcgctggatgctgctgctgttccagcttcctaggtgtggaaactgaaggaccaagagattaaacagtggtgcaaaagtggtaagaattcagcattctcctcgacaagtggacgagcatctactgtgctttcacagcggctatcactattgccagcagcaagactgtcagctcggcgccctcgtctggttggatgggaaactgcagttgctaagggagctgggtttgaatctctgaggacaaatgggaattctcactgatttctaggactaccctggggcaggcaccctgcacagcaatacacactgaacaatgtcgagtttctgctgaatagacttcctacgttgctctggaattcgaagttggcctaactgaggtctccagttacagaaaacactggctctgtatcctgggctttgagaaaacttatcaggctgtcacacttaccatcccttcagtctgcttgtcaggttccttaaggacgcatatctcaaatgtatggcatctacctctacctgggtcacaaccaagtgggtttctactagatcggtgttccttgacagccaacaagggagctgacactgccctcctaagttctgatcttgctcctgttcaactggaacttgatggatcccatgtggtttcccccatcctgacgctgtggctcagacactctccctaagctggtccttccctccaaatcctgccttaaacacactcagaaggtagaaaacacttcagcagcaaagtcctcttcccaagccaacagttgtgttcttccaatcacatgatcttaccttttcaataaaaggcaaaacaaaccaatttccaacatagcattacagcctttaaaaccattcacttctcatagtgattcacagagaacaagagattaaagtgctggattttaaatgtctaaagttgccttcagggctacaaaaagccctgccgtgtgtgtttttccttcatggtgttgaggggaaggaaagatagggaagggcagtggggagaaaccctaaaattttcaatcagaaactggaaattgtaaaagtgggaggtggggagttctgtgcaaatcaatctcccaaggttctgcgtcctctagtgagcctcaaagaaaaaaaaaaaaacaaaaaggtggggactcgcaaaaaggatgagggaaaggctccagacctac

SEQ ID NO: 288232 - DNA, 1158 bp, Homo sapiens
caggtgccagagttcgtatatgactccagtcctggcgctggatgctgctgctgttccagcttcctaggtgtggaaactgaaggaccaagagattaaacagtggtgcaaaagtggtaagaattcagcattctcctcgacaagtggacgagcatctactgtgctttcacagcggctatcactattgccagcagcaagactgtcagctcggcgccctcgtctggttggatgggaaactgcagttgctaagggagctgggtttgaatctctgaggacaaatgggaattctcactgatttctaggactaccctggggcaggcaccctgcacagcaatacacactgaacaatgtcgagtttctgctgaatagacttcctacgttgctctggaattcgaagttggcctaactgaggtctccagttacagaaaacactggctctgtatcctgggctttgagttaaggacgcatatctcaaatgtatggcatctacctctacctgggtcacaaccaagtgggtttctactagatcggtgttccttgacagccaacaagggagctgacactgccctcctaagttctgatcttgctcctgttcaactggaacttgatggatcccatgtggtttcccccatcctgacgctgtggctcagacactctccctaagctggtccttccctccaaatcctgccttaaacacactcagaaggtagaaaacacttcagcagcaaagtcctcttcccaagccaacagttgtgttcttccaatcacatgatcttaccttttcaataaaaggcaaaacaaaccaatttccaacatagcattacagcctttaaaaccattcacttctcatagtgattcacagagaacaagagattaaagtgctggattttaaatgtctaaagttgccttcagggctacaaaaagccctgccgtgtgtgtttttccttcatggtgttgaggggaaggaaagatagggaagggcagtggggagaaaccctaaaattttcaatcagaaactggaaattgtaaaagtgggaggtggggagttctgtgcaaatcaatctcccaaggttctgcgtcctctagtgagcctcaaagaaaaaaaaaaaaacaaaaaggtggggactcgcaaaaaggatgagggaaaggctccagacctac

SEQ ID NO: 288233 - DNA, 725 bp, Homo sapiens
  misc_feature (5)..(5): n is a, c, g, or t
  misc_feature (79)..(79): n is a, c, g, or t
ccgcnccccaacgcatgtgccgctccccaacgcatgtgccgctccccaacgcatgtgccgctcccaacgcatgtgccgntcccaacgcatgtgccgctcccaacgcatgtgccgctcccaacgcatgtgccgctcccaacgcatgtgccgctcctgttcaactggaacttgatggatcccatgtggtttcccccatcctgacgctgtggctcagacactctccctaagctggtccttccctccaaatcctgccttaaacacactcagaaggtagaaaacacttcagcagcaaagtcctcttcccaagccaacagttgtgttcttccaatcacatgatcttaccttttcaataaaaggcaaaacaaaccaatttccaacatagcattacagcctttaaaaccattcacttctcatagtgattcacagagaacaagagattaaagtgctggattttaaatgtctaaagttgccttcagggctacaaaaagccctgccgtgtgtgtttttccttcatggtgttgaggggaaggaaagatagggaagggcagtggggagaaaccctaaaattttcaatcagaaactggaaattgtaaaagtgggaggtggggagttctgtgcaaatcaatctcccaaggttctgcgtcctctagtgagcctcaaagaaaaaaaaaaaaacaaaaaggtggggactcgcaaaaaggatgagggaaaggctccagacctac

SEQ ID NO: 288234 - DNA, 670 bp, Homo sapiens
acttatgactttgtgactttacagtggtgcaaaagtggtaagaattcagcattctcctcgacaagtggacgagcatctactgtgctttcacagcggctatcactattgccagcagcaagactgtcagctcggcgcccccatcctgacgctgtggctcagacactctccctaagctggtccttccctccaaatcctgccttaaacacactcagaaggtagaaaacacttcagcagcaaagtcctcttcccaagccaacagttgtgttcttccaatcacatgatcttaccttttcaataaaaggcaaaacaaaccaatttccaacatagcattacagcctttaaaaccattcacttctcatagtgattcacagagaacaagagattaaagtgctggattttaaatgtctaaagttgccttcagggctacaaaaagccctgccgtgtgtgtttttccttcatggtgttgaggggaaggaaagatagggaagggcagtggggagaaaccctaaaattttcaatcagaaactggaaattgtaaaagtgggaggtggggagttctgtgcaaatcaatctcccaaggttctgcgtcctctagtgagcctcaaagaaaaaaaaaaaaacaaaaaggtggggactcgcaaaaaggatgagggaaaggctccagacctac

SEQ ID NO: 288235 - DNA, 2127 bp, Homo sapiens
taatcagtggggaagcacggtccaagaacgtttgtttccatggccatttaagcttagtagtaaagactggttaatataccaatgcttgtaaaaccttcagaagggaaggagaatgttttgtggccactttggttttctttttcgcgtgggcagtttaaaggtaatagtttttaaaaacagtacttttaatggggaacaacttgcccaaaaatttggcccagaattttggggccccttaaaaaagttaaatgagaaaaaaaaaaaaaaagggcggccgcccttttttttttttttttttttttttttatttagtttttttttttggagtttgttttttatttagacatggaattttccttttcatataacttatctaattaaaatattcatctcggtagttaccacaaaaaagtaacatagaaaattgtatttacattttgggaccaaaatacaaatgaagagcaggatgacaccttgctcctttccctcccgcttcccagaaagaaaaagccccaaagaaactgctcagtacaccaaggatcacaaaagggtaatttgtaatttggtgatttgtatgtagtgtagcacagaaaaaaaattgcacaagtttttccataaatgagaccaaaggttcaaattcatcctgtgtcaggttcaaattcatcctgtgtctgctctgcagccattttagtaagctgggcaaggaggtcatttagaaattgggtttttcctctttcccctgactcttcgcaccaagtcacatccctgatgtagatactcttgggggaggggaaaacatctggctctatgcaaacagggctcatcaaaaatctttatgtgccaaaatggatactgacattgctatgaacaaatctgttttttcttccctccctgcctaaagactcctaataagggacattaaatcatacacaactgaatctaagatatgaaaaactagtttcaatgacaaagacttgaacacacagttaagagataaattcaaggtggtagacacctagaaaaagctattctaggcagcagacatctggcacctgacccaaatgttcatttggtttcagttaagaggcttcctaatattagatttgtggggcaggctagggataggggtggaatggtggtacaagtaaccaagagaagtaaagtaatgctttacccattcaaaaatatagcaaattaaaacatagtaacatttgtgtcctgtcacaataggcaccctgcacagcaatacacactgaacaatgtcgagtttctgctgaatagacttcctacgttgctctggaattcgaagttggcctaactgaggtctccagttacagaaaacactggctctgtatcctgggctttgagaaaacttatcaggctgtcacacttaccatcccttcagtctgcttgtcaggttccttaaggacgcatatctcaaatgtatggcatctacctctacctgggtcacaaccaagtgggtttctactagatcggtgttccttgacagccaacaagggagctgacactgccctcctaagttctgatcttgctcctgttcaactggaacttgatggatcccatgtggtttcccccatcctgacgctgtggctcagacactctccctaagctggtccttccctccaaatcctgccttaaacacactcagaaggtagaaaacacttcagcagcaaagtcctcttcccaagccaacagttgtgttcttccaatcacatgatcttaccttttcaataaaaggcaaaacaaaccaatttccaacatagcattacagcctttaaaaccattcacttctcatagtgattcacagagaacaagagattaaagtgctggattttaaatgtctaaagttgccttcagggctacaaaaagccctgccgtgtgtgtttttccttcatggtgttgaggggaaggaaagatagggaagggcagtggggagaaaccctaaaattttcaatcagaaactggaaattgtaaaagtgggaggtggggagttctgtgcaaatcaatctcccaaggttctgcgtcctctagtgagcctcaaagaaaaaaaaaaaaacaaaaaggtggggactcgcaaaaaggatgagggaaaggctccagacctac

SEQ ID NO: 288236 - DNA, 1053 bp, Homo sapiens
caggtgccagagttcgtatatgactccagtcctggcgctggatgctgctgctgttccagcttcctaggtgtggaaactgaaggaccaagagattaaacaggaatctctgaggacaaatgggaattctcactgatttctaggactaccctggggcaggcaccctgcacagcaatacacactgaacaatgtcgagtttctgctgaatagacttcctacgttgctctggaattcgaagttggcctaactgaggtctccagttacagaaaacactggctctgtatcctgggctttgagaaaacttatcaggctgtcacacttaccatcccttcagtctgcttgtcaggttccttaaggacgcatatctcaaatgtatggcatctacctctacctgggtcacaaccaagtgggtttctactagatcggtgttccttgacagccaacaagggagctgacactgccctcctaagttctgatcttgctcctgttcaactggaacttgatggatcccatgtggtttcccccatcctgacgctgtggctcagacactctccctaagctggtccttccctccaaatcctgccttaaacacactcagaaggtagaaaacacttcagcagcaaagtcctcttcccaagccaacagttgtgttcttccaatcacatgatcttaccttttcaataaaaggcaaaacaaaccaatttccaacatagcattacagcctttaaaaccattcacttctcatagtgattcacagagaacaagagattaaagtgctggattttaaatgtctaaagttgccttcagggctacaaaaagccctgccgtgtgtgtttttccttcatggtgttgaggggaaggaaagatagggaagggcagtggggagaaaccctaaaattttcaatcagaaactggaaattgtaaaagtgggaggtggggagttctgtgcaaatcaatctcccaaggttctgcgtcctctagtgagcctcaaagaaaaaaaaaaaaacaaaaaggtggggactcgcaaaaaggatgagggaaaggctccagacctac

SEQ ID NO: 288237 - DNA, 778 bp, Homo sapiens
taatcagtggggaagcacggtccaagaacgtttgtttccatggccatttaagcttagtagtaaagactggttaatataccaatgcttgtaaaaccttcagaagggaaggagaatgttttgtggccactttggttttctttttcgcgtgggcagtttaaaggtaatagtttttaaaaacagtacttttaatggggaacaacttgcccaaaaatttggcccagaattttggggccccttaaaaaagttaaatgagaaaaaaaaaaaaaaagggcggccgcccttttttttttttttttttttttttttatttagtttttttttttggagtttgttttttatttagacatggaattttccttttcatataacttatctaattaaaatattcatctcggtagttaccacaaaaaagtaacatagaaaattgtatttacattttgggaccaaaatacaaatgaagagcaggatgacaccttgctcctttccctcccgcttcccagaaagaaaaagccccaaagaaactgctcagtacaccaaggatcacaaaagggtaatttgtaatttggtgatttgtatgtagtgtagcacagaaaaaaaattgcacaagtttttccataaatgagaccaaaggttcaaattcatcctgtgtcaggttcaaattcatcctgtgtctgctctgcagccattttagtaagctggggggcgaagaggggggaaagggggggctcccaattttttttaaggaaaaaaaaaatatttgggggggtgtttttttttt

SEQ ID NO: 288238 - DNA, 588 bp, Homo sapiens
caggtgccagagttcgtatatgactccagtcctggcgctggatgctgctgctgttccagcttcctaggtgtggaaactgaaggaccaagagattaaacagtggtgcaaaagtggtaagaattcagcattctcctcgacaagtggacgagcatctactgtgctttcacagcggctatcactattgccagcagcaagactgtcagctcggcgccctcgtctggttggatgggaaactgcagttgctaagggagctgggtttgaatctctgaggacaaatgggaattctcactgatttctaggactaccctggggcagagatggagtttcatcacattgcctaggctggtctcgaaatcctggactcaagtgatctgctggcctcagcctccctaactgctgggactagaggcctgagcgaccacccctggctgtaaacattttcttagctcaaggattgctgaatttgtatccattttcttctctcctatctcaattgggtgggtgaaatgatactgttaattattttctgttacttttgaatgcttctttgtggcgaactgagggcatagtaatactgtagcagctaac

SEQ ID NO: 288239 - DNA, 598 bp, Homo sapiens
caggtgccagagttcgtatatgactccagtcctggcgctggatgctgctgctgttccagcttcctaggtgtggaaactgaaggaccaagagattaaacagtggtgcaaaagtggtaagaattcagcattctcctcgacaagtggacgagcatctactgtgctttcacagcggctatcactattgccagcagcaagactgtcagctcggcgccctcgtctggttggatgggaaactgcagttgctaagggagctgggtttgaatctctgaggacaaatgggaattctcactgatttctaggactaccctggggcagagatggagtttcatcacattgcctaggctggtctcgaaatcctggactcaagtgatctgctggcctcagcctccctaactgctgggactagaggcctgagcgaccacccctggctgtaaacattttcttagctcaaggattgctgaatttgtgcagccaatgcaatatgatggcaatgatagatgtcacttctagacaaaacttaacagttatatcaatattgtaattaatattattttttattattataattaatgttaataatatattaatattctctact

SEQ ID NO: 288240 - DNA, 782 bp, Homo sapiens
ttttttttttttgagacggagtcttaaaaaaaaaaaaaaaaaaaaaagaattttagtattgctagtcataattctttgacttttcctcctatttcccacctcttttaggtggaggttccagtttactaaatggaaacatttcttctgagaggatctgttccctggatctacttaaaaagctcagggttaaatgagaaggacctaacccttctcatatagcccaccaaggcttgtatcaagaacattagattacttccatgattgcttttaattctgacagtccatgaaatggtcataaggtatgggttgataaggacatggttctctagtattacagttcaccctaatatgttttaaattctcatttctaaggttaagtactaaccaatctgctaatttcctcttgtctatctggtgcagatcttgctgttgccttgatcatagtggaagtctgattgtctgttagcttcttgatacatcgttgccctgccacaatattacagacctacaaatggaaaaaagttttgtactacatgtatatatcttttttttttagctcttacttagtgccaattacatgtaaataaaaatttaaaatcaacttcattaaaccacttattttcaatatgttaagtaaaaaagtagtaaacaagacagctctacagtaattaagtataattaagtaaaatgtacaccagatgaagactgaaagaagtatagtataccaaaatgttaacagtggttacattagagtggtaggattatggatgaacttgtttcgt

SEQ ID NO: 288241 - DNA, 568 bp, Homo sapiens
cctaaaaatagaaaaagtttgtagttactctcaaaattcccccaaatcccctactttaatgcattagaaccctcttttttttcttcactgtgtccataatatattttccaacaggtctaatcaatggtgctctaactacagaacagcgaatcttaacctggggaccatgggtcatgaatggactgcagaaattctgtgacctcctgatcttgctgttgccttgatcatagtggaagtctgattgtctgttagcttcttgatacatcgttgccctgccacaatattacagacctacaaatggaaaaaagttttgtactacatgtatatatcttttttttttagctcttacttagtgccaattacatgtaaataaaaatttaaaatcaacttcattaaaccacttattttcaatatgttaagtaaaaaagtagtaaacaagacagctctacagtaattaagtataattaagtaaaatgtacaccagatgaagactgaaagaagtatagtataccaaaatgttaacagtggttacattagagtggtaggattatggatgaacttgtttcgt

SEQ ID NO: 288242 - DNA, 480 bp, Homo sapiens
cctaaaaatagaaaaagtttgtagttactctcaaaattcccccaaatcccctactttaatgcattagaaccctcttttttttcttcactgtgtccataatatattttccaacaggtctaatcaatggtgctctaactacagaacagcgaatcttaacctggggaccatgggtcatgaatggactgcagaaattctgtgacctcctgagaagtgttctgggtgagacaaggcttgaaagagacaaagaaggctggagccccgtggcagatgagatggttagatctgcaggcatactaactggaagagatacaacagaggctccctggaagaaggatgccagacacagttgagagcacaagactgtaccaaaaacaagagattaaatgactttaacatattaaatgctgaatacagaagttcccccagctagaactcccaactaggcttccagaatgcaggcaaccacactgctatccttta

SEQ ID NO: 288243 - DNA, 5642 bp, Homo sapiens
  misc_feature (4830)..(4830): n is a, c, g, or t
ccgtggagttgacagtcgtgtggaatgggcacttcaacattgacaacccagctcagaataaagttcacctctacaagtgtggagccatgcgtgagagctgcgggctgtgcctcaaggctgacccagacttcgcatgtggctggtgccagggcccaggccagtgcaccctgcgccagcactgccctgcccaggagagccagtggctggagctgtctggtgccaaaagcaagtgcacaaacccccgcatcacagagataatcccggtgacaggcccccgggaagggggcaccaaggtcactatccgaggggagaacctgggcctggaatttcgcgacatcgcctcccatgtcaaggttgctggcgtggagtgcagccctttagtggatggttacatccctgcagaacagatcgtgtgtgagatgggggaggccaagcccagccagcatgcaggcttcgtggagatctgcgtggctgtgtgtcggcctgaattcatggcccggtcctcacagctctattacttcatgacactgactctctcagatctgaagcccagccgggggcccatgtccggagggacccaagtgaccatcacaggcaccaacctgaatgccggaagcaacgtggtggtgatgtttggaaagcagccctgtctcttccacaggcgatctccatcctacattgtctgcaacaccacatcctcagatgaggtgctagagatgaaggtgtcggtgcaggtggacagggccaagatccaccaggacctggtctttcagtatgtggaagaccccaccatcgtgcggattgagccagaatggagcattgtcagtggaaacacacccatcgccgtatgggggacccacctggacctcatacagaacccccagatccgtgccaagcatggagggaaggagcacatcaatatctgtgaggttctgaacgctactgagatgacctgtcaggcgcccgccctcgctctgggtcctgaccaccagtcagacctgaccgagaggcccgaggagtttggcttcatcctggacaacgtccagtccctgctcatcctcaacaagaccaacttcacctactatcccaacccggtgtttgaggcctttggtccctcaggaatcctggagctcaagcctggcacgcccatcatcctaaagggcaagaacctgatcccgcctgtggctgggggcaacgtgaagctgaactacactgtgctggttggggagaagccgtgcaccgtgaccgtgtcagatgtccagctgctctgcgagtcccccaacctcatcggcaggcacaaagtgatggcccgtgtcggtggcatggagtactccccggggatggtgtacattgccccggacagcccgctcagcctgcccgccatcgtcagcatcgcagtggctggcggcctcctcatcattttcatcgtggccgtgctcattgcctataaacgcaagtcccgcgaaagtgacctcacgctgaagcggctgcagatgcagatggacaacctggagtcccgtgtggccctggagtgcaaggaaggtactgagtggccccatgctggaggccatgtgtgtgtgcgtgtgtgcatatgtgtgtgcatgcacatctgtgtatgtgtatgcatatgtttcatatacaaacaagcaggctgggcagcagtgggcagtgctggaggctggcggtgtgtgtgtctgtgcgaatgtgtgtgtgtgcatgtgtgtgtgtgcacatctgtatgtatatatgtttcatatacaagcaagcaggccgggcagcagtgagcagtgctggaggctgtatatgtgtctgtgtgcgtgcgcatctgtgtatgtgtatatgtttcatgtacaagcaagcaggccgggcagcagtgggcagtgctggaggctctgtgtgtgcgtgtgcatgtgtgtgtatgtatgtgtatgtgttccatttacaagcaagcaggccaggcaactgtgagcagtgctggaggctgtgtgcgcgtgtgtgtgtgtatgtgtatgtgtttcatttacaagcaagcaggccaggcagctgtgagcagtgctggaggctgtgtgtgtgtgtgtgtgagcacgcacgtgtgtgagcacgcacgtgtatgtgtatgtgtgtcatttacaagcaagcaggccaggcagctgtgagcagtgctggaggccgtgtgtgtgtgtgtgtgtgtgtgtgcgcgcgcgcctgtatatgtgtatgtgtttcatttacaagcaagcaggccaggcagctgtgggcagtgctggaggctgtgtgtgtgtgcacgtgtgtgtatgcgtatgtgtttcatttacaagcaagcaggccaggcagctgtgggcagtgctggaggctgtgtgtgtgtgtgtgtgtgtgtgtgtgtatatatgtgtatgtgtatgtgtttcatttacaagcaagcagcccaggcagctgtgggcagtgctggaggctgtgtgtgtgtgtgtgtgtgtgtgtgtatgtgtttcatttacaagtgtgtgtgtgtgtgtgtatgtgtatgtgtatgtgtttcatttacaagcaagcaggccaggcagctgtgggcaatgctggaggctgtgcatcctacctgcatacctgcaaagcctctcactctatagtccctatgcctgtgtcccagaccacacccatacccaagcaggccccaccctggcaacaccagagaggccaaggtctccttgccctctccttgaaggtgtagtgattagaatctcttttatgtgtggcaggcacacagctttgaatgttggaggcgcttggtgacttaaaggaaagctgcagactgataaaaagccaactccctccttctgctccctgtgggccgagcaccccaactgggagggggcagccgaggggagctcccacccaggattgtcaccttcaccccactagagcaccttcaccccactagagcagcctccatacctggaatcctggttgagtgggttttgcactctactcgaggggaggtctgggggtgtcttaacatgacgcatttcagcaatctccagctttcttcctctagcaggaaggtaaggctgtagggctgatctgtgatttagaaggaagggtgtttcaaagcttgtattaaaaaattacaaacaccaccataaagtgaaatcagctgcactaaatccaagaaggaaatttaggagtcagactcttgtaacccccaggatatcattttgtgactcatcctgggaggatctgagctggttctttgctgtagatttgtacatggagtaaatccggccccatacctggggctctcacttcacaccgattcccaccagggcagccacggctctttttgatggggaagtggatccattccatcccctctctacatccttcagctgtcaacacagcatccgccttgtgggactgttaattactgccttttattatatttacgctgcttaatttttttctccgcaatgtactctttcctctaattaggtgtagtgattagaatctcttttatgtgtggcaggcacgcagctttgaatgttggaggcgcttggtgacttaaaggaaagctgcagactgataaaaagccaacaccctccttctgctccctgtgggccgagcaccccaactgggagggagcagccgatgggagctcccacccaggattgtcagctgaggccccaggaggaaaccttggcttcagactttaggggcgagctatgctgtgcacgtaggaagaaggggtcttacagcaaaggacttgtcagactagccacagaggcactttgcagcttgcccagagccagccactgaacgtttacagggctgcactggcccaagccaaggggtctccttgaagacttcacagcaagccaggacgtcctctacacaaactcagaagacacccagctgggcccttcatgggcctaagcttctgatatataaacatacccgtgtatttacaaacactcccacacaggcccacacaccctcactgacatacactcatggactcacacatacactcacatgcacacatgcatgcacactcacatacactcactcgtgcactcacacatacatgcccacacatagtgacatgctcacacactcatgctttcacatacatacactcactgacatacactcatgtgctcacacgctcatgtactcacattcgtacacacacactgacatatacttacacactcacacttgcacatgcatacacatgcactcacatgcacacatgcatgcacactcatacactcacgcactcaacttgcaggcgtgcacacacatgcccacatactcatgcactcacattcacacatgcgtgcacacatagacgcatgcactcacacatgcatacacacagacatacacatgcactcacattcgtacttgcatacacaccaacacacatatgcacactcacactgacaagcatacacacacactcatgcactcacacccacgcaggcactcacattcacacacatacacactcattgacatacattcattcacatccatgcactcacattcacacatgcatacacactgacattcacacttgcacatgcctacacactcactgacatacacacacacatgcagtcatacacactccctgacatgctcacacactgtcatactcacacactccctgacatgctcacacactgtcacactcacacactcacatacactccctgacatacacactcagacaagtgcccatgcacccacacctatgctcatgcacatgttcccacactctcttataagcatacacacccatgttcctcactcaggacacacatgaatgttccncagggcatcatgtgacatcgcagaggacagatggtggaaaagacatgagcaacctaatgggaagaggaaaatgggaaacaatgcattggaagaggaagaaaaaaaataaataaccaaaggttttggcaagtgcagtaccaggtggagaagcttgacttttctatccttgatcattttattccctcccaagaagtcagtcacaggacctggaaggccagaaagggtgcatgtgggagacggtctgaggaagtacctcggtcactacaatatttttgcacatataaagggttggggaggaaagagacacaaacgtatttaacacagatttgctggatggaagctgcgtgtgtgaacgtgtgtatgagtgagtgcattttgatttttttttttttttttttgcacagttaagagaaaaaatcaaacaagcagaaaaaaaaaagaaaaaagacttatcacggttctgctgaagcttttattttttactggatgattattgttattgttactttggcggtacaggactttattttattcatgtttttgttataagaaaaatttcaaacacctcagagaaatagaaaggttaggaagaaagaggagacaaggacagacaaattttctggctgtccccatttctcctgggggaggggtttggggctggtttgactttaattggtgggtgggttgtttctgccgctctgtttgctgcagtccccgtggcctgcttggggactgagaaatttgagccaggtatccagagccacagcccatcttgcttataaaaattatcttctgctgtttgttttccattt

SEQ ID NO: 288244 - DNA, 1157 bp, Homo sapiens
gggaagaaaccacaccatttccagcaaagtccatggagcatccggtacttttaagaacacttgcccctttggatatgaatatgtgcacatgtgtgtgagcacatgtatgtgtgtgtgtgtgtctgccccaggtgtaggcggaaagctcaaaaggatttcttgtcctttgtaggaggatttttgaagtgttccccttctctttccccttgctcatccattcatcctgcagcttcaggacatttcaacacttacttgctttctatgctgagagctggtgggtggaaggagagggcgcttgtccataggaaatcagggtggtcgcctgccgaggcctggaccttggaacagggcatcatgtgacatcgcagaggacagatggtggaaaagacatgagcaacctaatgggaagaggaaaatgggaaacaatgcattggaagaggaagaaaaaaaataaataaccaaaggttttggcaagtgcagtaccaggtggagaagcttgacttttctatccttgatcattttattccctcccaagaagtcagtcacaggacctggaaggccagaaagggtgcatgtgggagacggtctgaggaagtacctcggtcactacaatatttttgcacatataaagggttggggaggaaagagacacaaacgtatttaacacagatttgctggatggaagctgcgtgtgtgaacgtgtgtatgagtgagtgcattttgatttttttttttttttttttgcacagttaagagaaaaaatcaaacaagcagaaaaaaaaaagaaaaaagacttatcacggttctgctgaagcttttattttttactggatgattattgttattgttactttggcggtacaggactttattttattcatgtttttgttataagaaaaatttcaaacacctcagagaaatagaaaggttaggaagaaagaggagacaaggacagacaaattttctggctgtccccatttctcctgggggaggggtttggggctggtttgactttaattggtgggtgggttgtttctgccgctctgtttgctgcagtccccgtggcctgcttggggactgagaaatttgagccaggtatccagagccacagcccatcttgcttataaaaattatcttctgctgtttgttttccattt

SEQ ID NO: 288245 - DNA, 5124 bp, Homo sapiens
  misc_feature (4312)..(4312): n is a, c, g, or t
ccgtggagttgacagtcgtgtggaatgggcacttcaacattgacaacccagctcagaataaagttcacctctacaagtgtggagccatgcgtgagagctgcgggctgtgcctcaaggctgacccagacttcgcatgtggctggtgccagggcccaggccagtgcaccctgcgccagcactgccctgcccaggagagccagtggctggagctgtctggtgccaaaagcaagtgcacaaacccccgcatcacagagataatcccggtgacaggcccccgggaagggggcaccaaggtcactatccgaggggagaacctgggcctggaatttcgcgacatcgcctcccatgtcaaggttgctggcgtggagtgcagccctttagtggatggttacatccctgcagaacagatcgtgtgtgagatgggggaggccaagcccagccagcatgcaggcttcgtggagatctgcgtggctgtgtgtcggcctgaattcatggcccggtcctcacagctctattacttcatgacactgactctctcagatctgaagcccagccgggggcccatgtccggagggacccaagtgaccatcacaggcaccaacctgaatgccggaagcaacgtggtggtgatgtttggaaagcagccctgtctcttccacaggcgatctccatcctacattgtctgcaacaccacatcctcagatgaggtgctagagatgaaggtgtcggtgcaggtggacagggccaagatccaccaggacctggtctttcagtatgtggaagaccccaccatcgtgcggattgagccagaatggagcattgtcagtggaaacacacccatcgccgtatgggggacccacctggacctcatacagaacccccagatccgtgccaagcatggagggaaggagcacatcaatatctgtgaggttctgaacgctactgagatgacctgtcaggcgcccgccctcgctctgggtcctgaccaccagtcagacctgaccgagaggcccgaggagtttggcttcatcctggacaacgtccagtccctgctcatcctcaacaagaccaacttcacctactatcccaacccggtgtttgaggcctttggtccctcaggaatcctggagctcaagcctggcacgcccatcatcctaaagggcaagaacctgatcccgcctgtggctgggggcaacgtgaagctgaactacactgtgctggttggggagaagccgtgcaccgtgaccgtgtcagatgtccagctgctctgcgagtcccccaacctcatcggcaggcacaaagtgatggcccgtgtcggtggcatggagtactccccggggatggtgtacattgccccggacagcccgctcagcctgcccgccatcgtcagcatcgcagtggctggcggcctcctcatcattttcatcgtggccgtgctcattgcctataaacgcaagtcccgcgaaagtgacctcacgctgaagcggctgcagatgcagatggacaacctggagtcccgtgtggccctggagtgcaaggaaggtactgagtggccccatgctggaggccatgtgtgtgtgcgtgtgtgcatatgtgtgtgcatgcacatctgtgtatgtgtatgcatatgtttcatatacaaacaagcaggctgggcagcagtgggcagtgctggaggctggcggtgtgtgtgtctgtgcgaatgtgtgtgtgtgcatgtgtgtgtgtgcacatctgtatgtatatatgtttcatatacaagcaagcaggccgggcagcagtgagcagtgctggaggctgtatatgtgtctgtgtgcgtgcgcatctgtgtatgtgtatatgtttcatgtacaagcaagcaggccgggcagcagtgggcagtgctggaggctctgtgtgtgcgtgtgcatgtgtgtgtatgtatgtgtatgtgttccatttacaagcaagcaggccaggcaactgtgagcagtgctggaggctgtgtgcgcgtgtgtgtgtgtatgtgtatgtgtttcatttacaagcaagcaggccaggcagctgtgggcaatgctggaggctgtgcatcctacctgcatacctgcaaagcctctcactctatagtccctatgcctgtgtcccagaccacacccatacccaagcaggccccaccctggcaacaccagagaggccaaggtctccttgccctctccttgaaggtgtagtgattagaatctcttttatgtgtggcaggcacacagctttgaatgttggaggcgcttggtgacttaaaggaaagctgcagactgataaaaagccaactccctccttctgctccctgtgggccgagcaccccaactgggagggggcagccgaggggagctcccacccaggattgtcaccttcaccccactagagcaccttcaccccactagagcagcctccatacctggaatcctggttgagtgggttttgcactctactcgaggggaggtctgggggtgtcttaacatgacgcatttcagcaatctccagctttcttcctctagcaggaaggtaaggctgtagggctgatctgtgatttagaaggaagggtgtttcaaagcttgtattaaaaaattacaaacaccaccataaagtgaaatcagctgcactaaatccaagaaggaaatttaggagtcagactcttgtaacccccaggatatcattttgtgactcatcctgggaggatctgagctggttctttgctgtagatttgtacatggagtaaatccggccccatacctggggctctcacttcacaccgattcccaccagggcagccacggctctttttgatggggaagtggatccattccatcccctctctacatccttcagctgtcaacacagcatccgccttgtgggactgttaattactgccttttattatatttacgctgcttaatttttttctccgcaatgtactctttcctctaattaggtgtagtgattagaatctcttttatgtgtggcaggcacgcagctttgaatgttggaggcgcttggtgacttaaaggaaagctgcagactgataaaaagccaacaccctccttctgctccctgtgggccgagcaccccaactgggagggagcagccgatgggagctcccacccaggattgtcagctgaggccccaggaggaaaccttggcttcagactttaggggcgagctatgctgtgcacgtaggaagaaggggtcttacagcaaaggacttgtcagactagccacagaggcactttgcagcttgcccagagccagccactgaacgtttacagggctgcactggcccaagccaaggggtctccttgaagacttcacagcaagccaggacgtcctctacacaaactcagaagacacccagctgggcccttcatgggcctaagcttctgatatataaacatacccgtgtatttacaaacactcccacacaggcccacacaccctcactgacatacactcatggactcacacatacactcacatgcacacatgcatgcacactcacatacactcactcgtgcactcacacatacatgcccacacatagtgacatgctcacacactcatgctttcacatacatacactcactgacatacactcatgtgctcacacgctcatgtactcacattcgtacacacacactgacatatacttacacactcacacttgcacatgcatacacatgcactcacatgcacacatgcatgcacactcatacactcacgcactcaacttgcaggcgtgcacacacatgcccacatactcatgcactcacattcacacatgcgtgcacacatagacgcatgcactcacacatgcatacacacagacatacacatgcactcacattcgtacttgcatacacaccaacacacatatgcacactcacactgacaagcatacacacacactcatgcactcacacccacgcaggcactcacattcacacacatacacactcattgacatacattcattcacatccatgcactcacattcacacatgcatacacactgacattcacacttgcacatgcctacacactcactgacatacacacacacatgcagtcatacacactccctgacatgctcacacactgtcatactcacacactccctgacatgctcacacactgtcacactcacacactcacatacactccctgacatacacactcagacaagtgcccatgcacccacacctatgctcatgcacatgttcccacactctcttataagcatacacacccatgttcctcactcaggacacacatgaatgttccncagggcatcatgtgacatcgcagaggacagatggtggaaaagacatgagcaacctaatgggaagaggaaaatgggaaacaatgcattggaagaggaagaaaaaaaataaataaccaaaggttttggcaagtgcagtaccaggtggagaagcttgacttttctatccttgatcattttattccctcccaagaagtcagtcacaggacctggaaggccagaaagggtgcatgtgggagacggtctgaggaagtacctcggtcactacaatatttttgcacatataaagggttggggaggaaagagacacaaacgtatttaacacagatttgctggatggaagctgcgtgtgtgaacgtgtgtatgagtgagtgcattttgatttttttttttttttttttgcacagttaagagaaaaaatcaaacaagcagaaaaaaaaaagaaaaaagacttatcacggttctgctgaagcttttattttttactggatgattattgttattgttactttggcggtacaggactttattttattcatgtttttgttataagaaaaatttcaaacacctcagagaaatagaaaggttaggaagaaagaggagacaaggacagacaaattttctggctgtccccatttctcctgggggaggggtttggggctggtttgactttaattggtgggtgggttgtttctgccgctctgtttgctgcagtccccgtggcctgcttggggactgagaaatttgagccaggtatccagagccacagcccatcttgcttataaaaattatcttctgctgtttgttttccattt

SEQ ID NO: 288246 - DNA, 5350 bp, Homo sapiens
  misc_feature (4538)..(4538): n is a, c, g, or t
ccgtggagttgacagtcgtgtggaatgggcacttcaacattgacaacccagctcagaataaagttcacctctacaagtgtggagccatgcgtgagagctgcgggctgtgcctcaaggctgacccagacttcgcatgtggctggtgccagggcccaggccagtgcaccctgcgccagcactgccctgcccaggagagccagtggctggagctgtctggtgccaaaagcaagtgcacaaacccccgcatcacagagataatcccggtgacaggcccccgggaagggggcaccaaggtcactatccgaggggagaacctgggcctggaatttcgcgacatcgcctcccatgtcaaggttgctggcgtggagtgcagccctttagtggatggttacatccctgcagaacagatcgtgtgtgagatgggggaggccaagcccagccagcatgcaggcttcgtggagatctgcgtggctgtgtgtcggcctgaattcatggcccggtcctcacagctctattacttcatggtgagtcttggccagcagtgatctggctgggtgcaggccacagagctcattaccatgattgctgggcccctctagagctctgtgagcaaacccagggcaagggcctgccctgcaacctccctcagttcatgagactcctgtcttatagtgagtgagagcacagcctttgaagtctggaagacctggattcaaatccagacttttctgtgcctggctgtgtggtttcagacactgactctctcagatctgaagcccagccgggggcccatgtccggagggacccaagtgaccatcacaggcaccaacctgaatgccggaagcaacgtggtggtgatgtttggaaagcagccctgtctcttccacaggcgatctccatcctacattgtctgcaacaccacatcctcagatgaggtgctagagatgaaggtgtcggtgcaggtggacagggcaaaaaaccccacaacgtcttgttttgttatgtggagaaccacccctccctcggtgcgatcaagcacgaacggatcactgtggaaacacacccatcgccgtatgggggacccacctggacctcatacagaacccccagatccgtgccaagcatggagggaaggagcacatcaatatctgtgaggttctgaacgctactgagatgacctgtcaggcgcccgccctcgctctgggtcctgaccaccagtcagacctgaccgagaggcccgaggagtttggcttcatcctggacaacgtccagtccctgctcatcctcaacaagaccaacttcacctactatcccaacccggtgtttgaggcctttggtccctcaggaatcctggagctcaagcctggcacgcccatcatcctaaagggcaagaacctgatcccgcctgtggctgggggcaacgtgaagctgaactacactgtgctggttggggagaagccgtgcaccgtgaccgtgtcagatgtccagctgctctgcgagtcccccaacctcatcggcaggcacaaagtgatggcccgtgtcggtggcatggagtactccccggggatggtgtacattgccccggacagcccgctcagcctgcccgccatcgtcagcatcgcagtggctggcggcctcctcatcattttcatcgtggccgtgctcattgcctataaacgcaagtcccgcgaaagtgacctcacgctgaagcggctgcagatgcagatggacaacctggagtcccgtgtggccctggagtgcaaggaaggtactgagtggccccatgctggaggccatgtgtgtgtgcgtgtgtgcatatgtgtgtgcatgcacatctgtgtatgtgtatgcatatgtttcatatacaaacaagcaggctgggcagcagtgggcagtgctggaggctggcggtgtgtgtgtctgtgcgaatgtgtgtgtgtgcatgtgtgtgtgtgcacatctgtatgtatatatgtttcatatacaagcaagcaggccgggcagcagtgagcagtgctggaggctgtatatgtgtctgtgtgcgtgcgcatctgtgtatgtgtatatgtttcatgtacaagcaagcaggccgggcagcagtgggcagtgctggaggctctgtgtgtgcgtgtgcatgtgtgtgtatgtatgtgtatgtgttccatttacaagcaagcaggccaggcaactgtgagcagtgctggaggctgtgtgcgcgtgtgtgtgtgtatgtgtatgtgtttcatttacaagcaagcaggccaggcagctgtgggcaatgctggaggctgtgcatcctacctgcatacctgcaaagcctctcactctatagtccctatgcctgtgtcccagaccacacccatacccaagcaggccccaccctggcaacaccagagaggccaaggtctccttgccctctccttgaaggtgtagtgattagaatctcttttatgtgtggcaggcacacagctttgaatgttggaggcgcttggtgacttaaaggaaagctgcagactgataaaaagccaactccctccttctgctccctgtgggccgagcaccccaactgggagggggcagccgaggggagctcccacccaggattgtcaccttcaccccactagagcaccttcaccccactagagcagcctccatacctggaatcctggttgagtgggttttgcactctactcgaggggaggtctgggggtgtcttaacatgacgcatttcagcaatctccagctttcttcctctagcaggaaggtaaggctgtagggctgatctgtgatttagaaggaagggtgtttcaaagcttgtattaaaaaattacaaacaccaccataaagtgaaatcagctgcactaaatccaagaaggaaatttaggagtcagactcttgtaacccccaggatatcattttgtgactcatcctgggaggatctgagctggttctttgctgtagatttgtacatggagtaaatccggccccatacctggggctctcacttcacaccgattcccaccagggcagccacggctctttttgatggggaagtggatccattccatcccctctctacatccttcagctgtcaacacagcatccgccttgtgggactgttaattactgccttttattatatttacgctgcttaatttttttctccgcaatgtactctttcctctaattaggtgtagtgattagaatctcttttatgtgtggcaggcacgcagctttgaatgttggaggcgcttggtgacttaaaggaaagctgcagactgataaaaagccaacaccctccttctgctccctgtgggccgagcaccccaactgggagggagcagccgatgggagctcccacccaggattgtcagctgaggccccaggaggaaaccttggcttcagactttaggggcgagctatgctgtgcacgtaggaagaaggggtcttacagcaaaggacttgtcagactagccacagaggcactttgcagcttgcccagagccagccactgaacgtttacagggctgcactggcccaagccaaggggtctccttgaagacttcacagcaagccaggacgtcctctacacaaactcagaagacacccagctgggcccttcatgggcctaagcttctgatatataaacatacccgtgtatttacaaacactcccacacaggcccacacaccctcactgacatacactcatggactcacacatacactcacatgcacacatgcatgcacactcacatacactcactcgtgcactcacacatacatgcccacacatagtgacatgctcacacactcatgctttcacatacatacactcactgacatacactcatgtgctcacacgctcatgtactcacattcgtacacacacactgacatatacttacacactcacacttgcacatgcatacacatgcactcacatgcacacatgcatgcacactcatacactcacgcactcaacttgcaggcgtgcacacacatgcccacatactcatgcactcacattcacacatgcgtgcacacatagacgcatgcactcacacatgcatacacacagacatacacatgcactcacattcgtacttgcatacacaccaacacacatatgcacactcacactgacaagcatacacacacactcatgcactcacacccacgcaggcactcacattcacacacatacacactcattgacatacattcattcacatccatgcactcacattcacacatgcatacacactgacattcacacttgcacatgcctacacactcactgacatacacacacacatgcagtcatacacactccctgacatgctcacacactgtcatactcacacactccctgacatgctcacacactgtcacactcacacactcacatacactccctgacatacacactcagacaagtgcccatgcacccacacctatgctcatgcacatgttcccacactctcttataagcatacacacccatgttcctcactcaggacacacatgaatgttccncagggcatcatgtgacatcgcagaggacagatggtggaaaagacatgagcaacctaatgggaagaggaaaatgggaaacaatgcattggaagaggaagaaaaaaaataaataaccaaaggttttggcaagtgcagtaccaggtggagaagcttgacttttctatccttgatcattttattccctcccaagaagtcagtcacaggacctggaaggccagaaagggtgcatgtgggagacggtctgaggaagtacctcggtcactacaatatttttgcacatataaagggttggggaggaaagagacacaaacgtatttaacacagatttgctggatggaagctgcgtgtgtgaacgtgtgtatgagtgagtgcattttgatttttttttttttttttttgcacagttaagagaaaaaatcaaacaagcagaaaaaaaaaagaaaaaagacttatcacggttctgctgaagcttttattttttactggatgattattgttattgttactttggcggtacaggactttattttattcatgtttttgttataagaaaaatttcaaacacctcagagaaatagaaaggttaggaagaaagaggagacaaggacagacaaattttctggctgtccccatttctcctgggggaggggtttggggctggtttgactttaattggtgggtgggttgtttctgccgctctgtttgctgcagtccccgtggcctgcttggggactgagaaatttgagccaggtatccagagccacagcccatcttgcttataaaaattatcttctgctgtttgttttccattt

SEQ ID NO: 288247 - DNA, 287 bp, Homo sapiens
ggggacccacctggacctcatacagaacccccagatccgtgccaagcatggagggaaggagcacatcaatgtgagtgtagggctgatggggttcatggaggctgcccatgcaacacgttgcttccccaaagggtgtgggtcttcccaagtactgaggtaactccctgcccatacactgataacccacagcctgacacccttgaatactaggatagtggaataggggggaagacataagggcatttttacttcttggggtatagacatggaggagtaattacttttgg

SEQ ID NO: 288248 - DNA, 533 bp, Homo sapiens
aagaagttacagagtatgaagacgcaaaccgtcactaagccagctagggaagaacacacctttgatcttcagaggagcttatggcaaacactgggacagcccgctggctccccacaacacacacaggcacgcagaacgcgcctaatattatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttggtgagtgtgggggagcaggtgtgtctgggtggggggccctagggttggcctggctcacaccaaaaccctcaccctacccctgccagccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgcagacgcgcttaaaggtaccg

SEQ ID NO: 288249 - DNA, 424 bp, Homo sapiens
tgtcttcatgcaggtcacatgctcccactcctgcagctcgatcctggcattgggaatagcctcccagctgaccggggagatgagctggatggagaaggcctcctgctgggggcggatgtaccgctcatctctctcgatggtctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctcggtctccccatacgagcccgaaatctttctcatctagccccccccgccaacagatccgacgccataccatcatccatacgctact

SEQ ID NO: 288250 - DNA, 3332 bp, Homo sapiens
aggcggccgccagcgtcctcaccaccagcatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgcttgaa

SEQ ID NO: 288251 - DNA, 3402 bp, Homo sapiens
aggcggccgccagcgtcctcaccaccagcgtgacttgggactaggggttgggtctgggtccagacccggcccagccatcacacacctgccctccctcagatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgcttgaa

SEQ ID NO: 288252 - DNA, 3559 bp, Homo sapiens
aggcggccgccagcgtcctcaccaccagcgtgacttgggactaggggttgggtctgggtccagacccggcccagccatcacacacctgccctccctcagatggtcaccatggagcccgggtacctgttcctgggttctcgcctgggcaattccctcctcctcaagtacacggagaagctgcaggagcccccggccagtgctgtccgtgaggctgccgacaaggtgggtttcctgggcccattgggccaccacccttcatgtgggcactgctgtggcatgccactcagtgcccctcctgcctcacaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgagattgaggcagcagggcccccgtcccagccagcgcccccagcgggcccctgactcttgctgtgccgcaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgcttgaa

SEQ ID NO: 288253 - DNA, 3086 bp, Homo sapiens
ctctagaggatctgagcaggtctcgtcgggaacacagctggccactatcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgcttgaa

SEQ ID NO: 288254 - DNA, 4128 bp, Homo sapiens
aggcggccgccagcgtcctcaccaccagcatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacaggtggggtccggccggttcccaacaacactggctgatgctgccccagctgggggctgagggggaggggacaggataagggaccattggctccaccctgaggaccatgaaggagtgtccagagggcgatggggttgaggtcaacgaggtggaacctgtgacttggttgctccaaaggtctggaaaggggtggttgggaactggggctgcatcccctggggtccccaccactgctctgccggctcgccgggcaagccctcgcagggcctggcctccacacttctcaggagagctgacgtgagtgctagctctgccccttggctgctctgtgactttgggagggcacacaggctttctcatcctggttccctatttaagccaccacaccaccaggtcacttgagaccctgcctgggatgcggtgagtgcttcctgggtgcctgaggactcaggactgtccatgaaagagggcagccctggctccctctgcctggttttcagtccccagcatggcagtctgtgggctgccctttgcagcctccagtgccctcctggcctagctttcccatcccctgtggccagcacccctagccccagctgagcgtgggaaaatggacaggaggagccccagaggctgagtggcagccccttccaggacctcgccaggacacagctgcccctcacccacccctgctcccacagagctgagggcaacatcccagggctcttggcggcctgggcctgcctgcccctgcccttggctagccctggatcccctgacccctgtgcccccaccccagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgcttgaa

SEQ ID NO: 288255 - DNA, 3356 bp, Homo sapiens
aggcggccgccagcgtcctcaccaccagcatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggagcctgcccccctttggccctgacaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgcttgaa

SEQ ID NO: 288256 - DNA, 3195 bp, Homo sapiens
aggcggccgccagcgtcctcaccaccagcatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgcttgaa

SEQ ID NO: 288257 - DNA, 2740 bp, Homo sapiens
ccatctagaggatcctcaacttcgacggcgcatcacggattctgatctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgcttgaa

SEQ ID NO: 288258 - DNA, 3410 bp, Homo sapiens
aggcggccgccagcgtcctcaccaccagcatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggtacacctgtggcggcggtgctcgtgtctgggtgggtacccgcccaaggcacctctgacgcccccttcccgcccccaggatgccaagcccctggaggtgtacagcgtggacttcatggtggacaatgcccagctgggttttctggtgtctgaccgcgaccgcaacctcatggtgtacatgtacctgcccgaagagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgcttgaa

SEQ ID NO: 288259 - DNA, 3316 bp, Homo sapiens
aggcggccgccagcgtcctcaccaccagcatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttgccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccacccctacgggtgagcgtacgagctgatga

SEQ ID NO: 288260 - DNA, 2950 bp, Homo sapiens
aggcggccgccagcgtcctcaccaccagcatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatgaagtacatgccgggtgaagccggatcgccgaaggagagtgagaacgtcgtcgtcttggaagacacggcgtatcaggagcagaccgaccgggaactcgtctatgtcggtctgggtgcgggcgccctgggcctggtcggtgcagccctgttcttcctaccccggcgccgccggcatgaggcggtcgcggcctgagattgatccgg

SEQ ID NO: 288261 - DNA, 2118 bp, Homo sapiens
aggcggccgccagcgtcctcaccaccagcatggtcaccatggagcccgggtacctgttcctgggttctcgcctgggcaattccctcctcctcaagtacacggagaagctgcaggagcccccggccagtgctgtccgtgaggctgccgacaaggaagagcctccctcaaagaagaagcgagtggatgcgacggccggctggtcagctgcgggtaagtcggtgccgcaggatgaggtggacgagattgaagtgtacggcagcgaggcccagtcgggaacacagctggccacctactcctttgaggtgtgtgacagcatcctgaacattggaccctgtgccaatgccgccgtgggcgagcctgccttcctctctgaagagtttcagaacagccccgagccggacctggagattgtggtttgctccggccacgggaagaacggggctttgtcggtgctgcagaagagcatccggccccaggtggtgacaacctttgagcttcccggctgctatgacatgtggacagtcatcgccccggtgcgtaaggaggaggaggacaatcccaagggggagggcacagagcaggaacccagcaccacccctgaagcagacgacgacggccgcagacacggattcctgattctgagccgggaagactccaccatgatcctgcagacggggcaggagatcatggagctggacaccagtggcttcgccactcagggccccacggtctttgctgggaacatcggggacaaccgctacattgtccaagtgtcaccactgggcatccgcctgctggaaggagtgaatcagctgcacttcatccccgtggacctgggcgcccccatcgtgcagtgcgccgtggccgacccctatgtggtcatcatgagtgccgagggccacgtcaccatgttcctgctgaagagtgactcctacggtggccgccaccaccgcctggcgctgcacaagcccccgctgcaccatcagtccaaggtgattacgctgtgcctgtaccgagacctcagcggcatgttcaccactgagagccgcctgggtggggcccgtgacgagctcgggggccgcagtggcccggaggccgagggcctgggctcagagactagccccacagtggatgacgaggaggagatgctgtatggggattcgggctccctcttcagccccagcaaggaggaggcccgaagaagcagccagccccctgctgaccgggaccctgcacccttccgggcagagcctacccactggtgcctgctggtgcgggagaatggcaccatggagatctaccagcttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccagggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacaggcgagctgaggatcagtgtctgctgctaactgtctatgatgccaatggctgtcgggagatccggtgggtgaggcactattgctccagggaggtcaaggtttgtgtgggcacacacaacgcgtggccggccacacatatgggggagcgttgactcaaaatagggtatgccgggcgcttcaccaccgagggggcccagggaggtggttggcaacacttaagggcgacaggg

SEQ ID NO: 288262 - DNA, 545 bp, Homo sapiens
  misc_feature (88)..(88): n is a, c, g, or t
gctccttcgtgggcacgcgctcctacatggctccggagcggttgcagggcacacattactcggtgcggtcggacatctggagcatggncctgtccctggtggagctggccgtcggaaggtaccccttccccccgccgtctccaccctggacggcggcatcgggctgctgctgcccatgcaggagaagacctaccggcggctgctgatgctgcagaacgcgctgaccaccatgctgccacaccacgccggcctcaacccccgcgccttccggatgctgcacgtggaccgccgcaccctccagaatgccgtgcgcaacgtgctggatggggagctgctcaaccgctacctgtacctgagcaccatggagcgcagcgagctagccaagaagatcggcaccacaccagacataatcctggacgacttgctggagacggaccgcgtcaccgcccacttctagccccgtggatgccgtcaccaccagcacacggaactacctcccaccccctttttgtacaaaacacaaggaaaaacattttttgcttgaa

SEQ ID NO: 288263 - DNA, 865 bp, Homo sapiens
cctttcccagcgccggctgtttctcactggcaacgccacgcctttgtcagcgttatcggacgctctctggcggcaaccttctcacggccaaaaattatcttttgcaactgcacagacatttgctacgggcagctgatcgctgggtcccagcgccgctggtttcacaatttcgcgggtgccccccaccatccccagcccgcagcataatcggtgaagggagcctgcggtttctccgccgcgccttcgcccgttgcgtcctgcgaagccagtggaatcggtggtcacaaggttggtttcaccaagtcgggcgtttcttggcactggcaccgctctgcgcttttgctggcccaggccggtctcagcaccgttaggtgctctctaaaggcgactgtctgtcgtggttaggaaagctgctatgggacgacagttttttagaagtttctagtctagcccagctggcggtttctggatcgcagaaccactgattgcgcggagctggatgtacttctgtggccgcgcatgtttctctgtggtatccctacggctgtcgtcgaaatcgcggtgtttctctggccccaccgccacgtgggcaacttcttcagtggctgcggggttctctccactgagttgctggttttgatccacgctttctcccagagagcagacgagacacttttctgtttgtgtcaactgctagtcgtgctgtgcacagtttcctcgtctcggtgcggggctttctccatccgaggccctctagtgccggcttcgcggtcgcagcacccggcgtttccgttggctctttcgccagcggcgcgaagccggcggttttgctgtcacagcacttgctgcacggagtttctcggta

SEQ ID NO: 288264 - DNA, 530 bp, Homo sapiens
cctttcccagcgccggctgtttctcactggcaacgccacgcctttgtcagcgttatcggacgctctctggcggcaaccttctcacggccaaaaattatcttttgcaactgcacagacatttgctacgggcagctgatcgctgggtcccagcgccgctggtttcacaatttcgcgggtgccccccaccatccccagcccgcagcataatcggtgaagggagcctgcggtttctccgccgcgccttcgcccgttgcgtcctgcgaagccagtggaatcggtggtcacaaggaaattatgacaggagcaacctgcaggggtttagatctgacagaaatattctaatggtaggcattgcatcgcttagccatatttgtaatttcttctttgtagggttggttctctgtaacttttgcttaccttaaaattatttttgtgtcttgctctgaggacaatgttaccgatgtgtttttcatttttacttgcatttcagactttcattattttaaattatgtattttttttttcttcta

SEQ ID NO: 288265 - DNA, 1349 bp, Homo sapiens
acaggagctgctgccgggcagaagaaaagcagggcaggctggctcccaggcctcagggtggggatggcagtgggaatgaagcacctgtaactgggcccttcctgccctaatgttcagggggccctacccctcgtgagcttgtcttattaagaaccctcaaaaggcctaagttaaccagcaggtccaaaggtcccaaggaacaaggtcagagacgccagggaaaagaggtgagctgtgcaggactagcactgggaaaactggcaatttgtgttgtcaagtgtgtgcctgtgcaagtgctccaactgctgctttgggtgaacttcaggccttgcctcttccctatcaccatcgtctccatcaacaccctctttcttttccagcctctcctggtgccttaggaatcagacgccaataaaccacagagcccagcatgtccaccttcgcttttattgagtagttagtgttctcaagctggctcacacccatgcggtcagctggggcctagggtggctctttgcaaagctgaggggcaagctaaggaagccaggcaggtcaggggccctttcggccttctcaagcctccacctgagttctcgtcaatgccagtctccctggtatgattggggacattatcagagaaacatctaatagcgcacatctgggcacccacactctgcttcagttgcatccatcctcccaccccaaattcaactcctgacccaatacaaaagacttttttaaccaggatttcttcttgcaggaaagctgacttggaaacacggggaggtggcagggaggggcaaaaaggactctggcaagcagatccacttgtctgggtccctgcagtgaagaacccaagatccaggtacctcagcctggaagaaaccgtgcactgcaggtcttcccttctatcaaaactaaaagcaaggaacagaagtcaattgaaaccccaggtcatcctacccaccttctggcagtctctggataatgatctaaggaaataagcttacatttataattagaggataatttggagaatttatactatttacacggaccaccctgcaaagatcagggaaggctggatttcttcctccttgatagtctgaactggaagcaaaggagaaaacccttctccaaacaggagtttctcctctttccctggtcctgcagaagaaagaggagctatcccctcctcagctagcagcacctgaaagggaaacagagataaggtgaaccaacggtcaccagacaggacgcacaaaaatatcacatacgggttctgatcctctttgtgtcgttttgaagtcttaaaatctattaaatatgagaatacgatgtatgttgaa

SEQ ID NO: 288266 - DNA, 393 bp, Homo sapiens
tgggacgaatcctcccaggagtgagatgattcctctttgaaagatggggccggggagggccactcttccaagggagggctctccactttgatgggtctcgctaagtgtggcatttcctccccaggctggatttcttcctccttgatagtctgaactggaagcaaaggagaaaacccttctccaaacaggagtttctcctctttccctggtcctgcagaagaaagaggagctatcccctcctcagctagcagcacctgaaagggaaacagagataaggtgaaccaacggtcaccagacaggacgcacaaaaatatcacatacgggttctgatcctctttgtgtcgttttgaagtcttaaaatctattaaatatgagaatacgatgtatgttgaa

SEQ ID NO: 288267 - DNA, 1196 bp, Homo sapiens
acaggagctgctgccgggcagaagaaaagcagggcaggctggctcccaggcctcagggtggggatggcagtgggaatgaagcacctgtaactgggcccttcctgccctaatgttcagggggccctacccctcgtgagcttgtcttattaagaaccctcaaaaggcctaagttaaccagcaggtccaaaggtcccaaggaacaaggtcagagacgccagggaaaagagcctctcctggtgccttaggaatcagacgccaataaaccacagagcccagcatgtccaccttcgcttttattgagtagttagtgttctcaagctggctcacacccatgcggtcagctggggcctagggtggctctttgcaaagctgaggggcaagctaaggaagccaggcaggtcaggggccctttcggccttctcaagcctccacctgagttctcgtcaatgccagtctccctggtatgattggggacattatcagagaaacatctaatagcgcacatctgggcacccacactctgcttcagttgcatccatcctcccaccccaaattcaactcctgacccaatacaaaagacttttttaaccaggatttcttcttgcaggaaagctgacttggaaacacggggaggtggcagggaggggcaaaaaggactctggcaagcagatccacttgtctgggtccctgcagtgaagaacccaagatccaggtacctcagcctggaagaaaccgtgcactgcaggtcttcccttctatcaaaactaaaagcaaggaacagaagtcaattgaaaccccaggtcatcctacccaccttctggcagtctctggataatgatctaaggaaataagcttacatttataattagaggataatttggagaatttatactatttacacggaccaccctgcaaagatcagggaaggctggatttcttcctccttgatagtctgaactggaagcaaaggagaaaacccttctccaaacaggagtttctcctctttccctggtcctgcagaagaaagaggagctatcccctcctcagctagcagcacctgaaagggaaacagagataaggtgaaccaacggtcaccagacaggacgcacaaaaatatcacatacgggttctgatcctctttgtgtcgttttgaagtcttaaaatctattaaatatgagaatacgatgtatgttgaa

SEQ ID NO: 288268 - DNA, 814 bp, Homo sapiens
cacaacctttgaagaaggcagggcaacaggggtgaggaagctggctgggtttgggaggtaaccacagctgctgggacgaggactcctctggccaaccggaacaagctggaatcttcggtgtcagaggaaccctggccacggtgcaaggacaggctggcctgaaggaggcacccaggcatcgggagcagctggacggtcaacagggtgaagggagttgagaagggcaccggggacgggagaggcagtggccccagggtctctgctaggttgcaagtgaatcaaaagcaaccacacaggaaaagtgtcaggcacagggcagaggctcaagcaccctccagtgaggcccatggtgtagagaaacaaacagacaccaggatggacacgggcacccatccctccaggcgctgtggacctgggacagccacggaattgcttgcagtcagatggcgcaggacggtggatggcatctgaggactctctctgctccagacatcattccaggaaagtgacgggactggcctgtgcctctccccagggtttctggctccctgtctccagagtcctacttgaagtgcttttttaaggccagctgcctccaatccgttgctgtccaccaaggtctgggcccagatgacgctgccagccccttgccctctctttctaccacaaactcctgctgctacccaatctccccccttaatcctcccaacagcatcctgcctatgtcactctggcccctctgtctgctgaccacccaccttctctccatcagttggccaccacctcagaagccacctgctcttgcaggcttctt

SEQ ID NO: 288269 - DNA, 777 bp, Homo sapiens
agcggagtgaagcccatgagccactagaagccacatgttctgccatgtggagaagaatgagagagtacatcctcaaattgaggtgtggcatgatgatttggctgcccagaggagaacctgtctttcccatctaaagtgggaggtcaagccaagtagagggaaacagcaactggagagcagatttgcaaaccagaaaagcaactcatgaatacaaattgcctggaaagcatttattacaacagaagctctgcaagatataccggaaattgacagtggcatcgaattcccagcaaggaagttttctaaggacaccaacagacaccagcagaagacagccttgcatttacaacaaaccattgatccacaacaaaccattgatccacactttcaaaatcattgaggtgaagcatagagaactggagtggagacggctctggcaaatccaaacaatatcaaaagcactctcatactgaaaacccacagtgctgaaccacagctgagatgtaaaatatttcacaaaatcttcttcaccctctatagtatttcacctgagagtgcatgatttaagttgcaagcactgtcatagatgatgggattcagagatgaacacatggaaatggactttatgttctctaatgtcacaaagaaagagtgattatgaagaagacccagattcccacctattaatctgagctttgaattctttactttgctgggtccaccggattttttctccactcagcccatcgatgagagtggaggcggcctgcatctttt

SEQ ID NO: 288270 - DNA, 454 bp, Homo sapiens
agcggagtgaagcccatgagccactagaagccacatgttctgccatgtggagaagaatggggacttgggaatctgtggctctgagtgcaacaacacctttagaacaatgtgtaaaccttcttcttactgtcggcccctctgcaacctggagacagagcaggtctcactggagcaacagtattgctaatgtaggagtcactggtgcgagaagcagccactagagagagccacctgcaggcctggcacagagacaaactcaccccttttcttcttggttgtttccaaagaaatgttttcatgtaatcctgagctttagagacaccaggagaagaaatctaagctacctttgtgtttcctaaactaacccagaacaatgacagcccttcctattcccccaaaatatcctggctctgccgcttgttagctgcataaacttgaacaaaaaaacatgaat

SEQ ID NO: 288271 - DNA, 383 bp, Homo sapiens
ctttcaagggcctgtgcctgtggtaactgtctatgagccaggtatatctgaagcatatttgacaacagaaaaagttaatgtaattttcaaaggaaaaacgccaacttttttcaaaaaggctggatccagctcttcatgaatgtcctcaatgagaaggggtcggcccaaggaaaggctgtcctccaagtgtgtgcgaaaatatttatggttcagagatgtcacctaaacagaaagaactcattggtctatctgtgttacaaagaatgtgcccattgctaagggaaaccgagagatttgttggacaggtaatcaagaattttaagggcaatagaagaagacttacttaaaaaaattaaagtaacatacaaaaattaatttctaaa

SEQ ID NO: 288272 - DNA, 736 bp, Homo sapiens
ctttcaagggcctgtgcctgtggtaactgtctatgagccaggtatatctgaagcatatttgacaacagaaaaagttaatgtaattttcaaaggaaaaacgccaacttttttcaaaaaggaaacagcaactggagagcagatttgcaaaccagaaaagcaactcatgaatacaaattgcctggaaagcatttattacaacagaagctctgcaagatataccggaaattgacagtggcatcgaattcccagcaaggaagttttctaaggacaccaacagacaccagcagaagacagccttgcatttacaacaaaccattgatccacaacaaaccattgatccacactttcaaaatcattgaggtgaagcatagagaactggagtggagacggctctggcaaatccaaacaatatcaaaagcactctcatactgaaaacccacagtgctgaaccacagctgagatgtaaaatatttcacaaaatcttcttcaccctctatagtatttcacctgagagtgcatgatttaagttgcaagcactgtcatagatgatgggattcagagatgaacacatggaaatggactttatgttctctaatgtcacaaagaaagagtgattatgaagaagacccagattcccacctattaatctgagctttgaattctttactttgctgggtccaccggattttttctccactcagcccatcgatgagagtggaggcggcctgcatctttt

SEQ ID NO: 288273 - DNA, 393 bp, Homo sapiens
tcatggttcctgcaggcagattaaccctgtcccttttcttgctactgacatcagctcccctcgttttggtggtaggcgaagcagcagagttgggcgcacttgacgttttagaaccccagacctccctcgtaagaatgccacatggttaccatcggagacctgagtcctggcagctgtatttccccctgggtcacctggaaaagcattttgttgactaccttcatgatttggtgttttgaaaacgtgttttgtggtttgcactgcatctccagggcagagagctaattgcattatgttgtgcttctctctcttctgcctcatctgttcccctccttcctccttcctcttaccactgctcccctttctttaccttccgtgcccacccctcacccc

SEQ ID NO: 288274 - DNA, 830 bp, Homo sapiens
gaggagtgcatggtttccggcatttggctgggcctttgtctctcgctcccaccagagcttggaatccgtctctgctcttctgcattctccacctcgggagcccctggggactctgtgacggcctctgttgccctgtgatctgcaggtccggagagacgcacagctaagatgtcaggacatcctggaagctgggaaaggatctcttcccagggtgaaaggggactgagggcttggaagaaagaagttctgaaaacagactccctgccctcaacctgctaccaccaatgatttccgcctactaatgaacatacccactaggaatgggtgtggccagaatcttcacaaaacaagaagacttgatctgaggaattactctatagtggctttacctctaaaatttctcaccaaagaattacacaagtgcctagaggactcctggattatccctaccacaaaccctgaacctgaagcagcaacctggtctctctatcaccctgggcttgtggactaccaatcataatctcatccacctgcatggacacaggaatatgtcagaacataaccctgcctgaatcagtatctgtagcataaaccagtctttccagctaccatgcactgtcccccactcacgggtccttgatagcacctttccctcttctgtcttttgcttttctacaaaccctttctgatgtgcacagtgtgcctcaggtgcctgaatccagcacctactgggagtcagatgtcatgagttcaagattatagccctagacctggctgtcataagaacagacaaaaattagaaatacagtcttcatccttgaaaataaaag

SEQ ID NO: 288275 - DNA, 1090 bp, Homo sapiens
gaaccaggtgttttgtctatcttttctgggctttgcctacagtgagccttgtgacacccaggtgatcatactcttcttcctatgccctgctttcaggagaggattataacatctctggttgagaactctgtgatgtgactctccttgctggtgcatgctgtcagggaagattgtgacataaccctggctcagcacacagttgatgtgactcttgtgcttgttctctacccacaggtggaattgtgacatataacttggccaagcacacagatgtaatggtgtggtgactctcatacctagaactgggacctgtgcaggattgttaattcattactggacattcctgtgggtgtgattgttacatatgcctatgttcagcacccgagtgatttgattttgctgcctggtctcagtccaaatgtaagattgtgatttatcgctgaatccagcacctcggtgatttgactctccctttttttgtgggagggatcctgcaaattttgggtattgtcaattattgctgaatcctgtacccatgttatgactctcccaaatgtgccttacctgttgtggcacaatatatcacattagacattgttaaatattgttgggttcaacacctgggtgatggatgtaactttttttctgggcctgcctacaggggaccttgtgacataactcaatgcccatcatcatggtaatgttactctcttctcctgcctgatctctgctcacagagaaattgtgacacatcactggcctagcatctaggtgatgtgactctcctctttttttcaggctctgcatatttgggtattgtgacatattgctgaactcaacacctaagggatgggagtctcctacctaggcccttcctacaggggacattgtgacatgtctctgcattcctcatccaggagatgtgactctccttttctgcctacaccctgcctacacagaaagttgtggcatattgctgtggtcagcaaccagatgatatatttctcctgcctgggtctttattacaggaaagatgattgacatattactgggcccagcatccagatgatgtgactctcttcttctgttg

SEQ ID NO: 288276 - DNA, 684 bp, Homo sapiens
ttaagttggtgactttcagaccaagattgaacacactgttagtctgtgattccactaaggtgaaacagccagtaagagggattgtgtctctcattcaatgattcaattcattctaaaaatgtgacttgtgtacttggatttaacatacaggaggtgttgactctcataccaagaattggggtatatacaggattgttagtctcatccttggtctttccttcaggtgcagttttgacacacttctgtctagcagctgagtattgtgatcttcagaactggcccagcctacaaataggattgtgccacactgctggacccagcacctagatgatgtaactattctcctgccttggtgctactcaaaaaagacattaacatatctcagagccttgcacccaggtaatgtgagtctcctctcctgccttgctgctgcacacagaagcgggttatgtacaggattgttaatctcatttggaccttcctgcacctatgattgtgacacatgcctctgtgtagaacccaagtgagttttctctcctgtttggatttaacccacagatggaatcgtgacatatcgctgcaccagaaactaggtgatgtgactccatttccttgcctctgtgctttccacattaggcattgggacatatcactgggccttgcatccaggtgatgggagttttc

SEQ ID NO: 288277 - DNA, 807 bp, Homo sapiens
gaggagtgcatggtttccggcatttggctgggcctttgtctctcgctcccaccagagcttggaatccgtctctgctcttctgcattctccacctcgggagcccctggggactctgtgacggcctctgttgccctgtgatctgcaggtccggagagacgcacagctaagatgtcaggacatcctggaagctgggaaaggtagagacgcggtttcaccgtggtcttgatctcctgatcttgtgatccacccgcctcggcctcccaaagtgctgggattacaagtgtgagccaccgcgcctggctgcaactataatgttttgctaagttctatctcttcccagggtgaaaggggactgagggcttggaagaaagaagttctgaaaacagactccctgccctcaacctgctaccaccaatgatttccgcctactaatgaacatacccactaggaatgggtgtggccagaatcttcacaaaacaagaagacttgatctgaggaattactctatagtggctttacctctaaaatttctcaccaaagaattacacaagtgcctagaggactcctggattatccctaccacaaaccctgaacctgaagcagcaacctggtctctctatcaccctgggcttgtggactaccaatcataatctcatccacctgcatggacacaggaatatgtcagaacataaccctgcctgaatcagtatctgtagcataaaccagtctttccagctaccatgcactgtcccccactcacgggtctgatgaccttccttttgcttggttttaaacctttgttgcggg

SEQ ID NO: 288278 - DNA, 789 bp, Homo sapiens
taggtgatgtgattctcctgttttccctgggcctcaaatattttggatattgtaaaatattgctaggcccactacctatgggattgcatgctcctgcctgggctctgcccacagggaccttgtgacatatatctgcgtccatgacctaaaaggtgacacttcttgcctgcactgtgccctgaacaggaaatattgtgacatatccctggaaccagacaccaggtgatatggctcttctgcccctgtcttgcccccagggagcattgtgacatagtgcttagctcagcacccaggtgatgtgactctgttgcctgtgctgtgctttcaggagagaattgtaacatatccctggctgagcacccaggtgatatgacactcctgcttgtttccttccctcggggaagattgtgagataccttggctgaaatcccagcacctgagtgatctgactgtcttgcctaagaccagcccacagatggaatagtgacacacagctgaacccagaactgaggggatgtgattctatttttctgcattggtgctgctcacaggggacattgtgacatatcgctggaccttacacttaaatgatttgagtctcctcccctgccttggcactgcctacggaaggcattgggacatgtctgtgagccctatgcccaggttatgtgactctcctgcctgttccccgaccacataagcaattgtgacatattgctgggtttgacaccctggtaatgtaactctactgccaaaaaggagcattatgacatatatttccattcatta

SEQ ID NO: 288279 - DNA, 730 bp, Homo sapiens
gaggagtgcatggtttccggcatttggctgggcctttgtctctcgctcccaccagagcttggaatccgtctctgctcttctgcattctccacctcgggagcccctggggactctgtgacggcctctgttgccctgtgatctgcaggtccggagagacgcacagctaagatgtcaggacatcctggaagctgggaaagggtcttgccatctctaagctggacctggtgacctttttggagggaaagaaagagccctggactgtgaagagtgaggagaccatagctgcacagccagtccagatgtataatctcatccctgaacatttctgatggtgtgattatgacatgtgactttatctggcaacagagtgagttgttgctcccgcctgagcccagcccccagaaaggattgtgacatatcgttggacccagaattgaggctctgcatatttgggtattgtgacatattgctgaactcaacacctaagggatgggagtctcctacctaggcccttcctacaggggacattgtgacatgtctctgcattcctcatccaggagatgtgactctccttttctgcctacaccctgcctacacagaaagttgtggcatattgctgtggtcagcaaccagatgatatatttctcctgcctgggtctttattacaggaaagatgattgacatattactgggcccagcatccagatgatgtgactctcttcttctgttg

SEQ ID NO: 288280 - DNA, 899 bp, Homo sapiens
gaggagtgcatggtttccggcatttggctgggcctttgtctctcgctcccaccagagcttggaatccgtctctgctcttctgcattctccacctcgggagcccctggggactctgtgacggcctctgttgccctgtgatctgcaggtccggagagacgcacagctaagatgtcaggacatcctggaagctgggaaagggtcttgccatctctaagctggacctggtgacctttttggagggaaagaaagagccctggactgtgaagagtgaggagaccatagctgcacagccagtccagatgtataatctcatccctgaacatttctgatggtgtgattatgacatgtgactttatctggcaacagagtgagttgttgctcccgcctgagcccagcccccagaaaggattgtgacatatcgttggacccagaattgaggtgcagttttgacacacttctgtctagcagctgagtattgtgatcttcagaactggcccagcctacaaataggattgtgccacactgctggacccagcacctagatgatgtaactattctcctgccttggtgctactcaaaaaagacattaacatatctcagagccttgcacccaggtaatgtgagtctcctctcctgccttgctgctgcacacagaagcgggttatgtacaggattgttaatctcatttggaccttcctgcacctatgattgtgacacatgcctctgtgtagaacccaagtgagttttctctcctgtttggatttaacccacagatggaatcgtgacatatcgctgcaccagaaactaggtgatgtgactccatttccttgcctctgtgctttccacattaggcattgggacatatcactgggccttgcatccaggtgatgggagttttc

SEQ ID NO: 288281 - DNA, 546 bp, Homo sapiens
gaggagtgcatggtttccggcatttggctgggcctttgtctctcgctcccaccagagcttggaatccgtctctgctcttctgcattctccacctcgggagcccctggggactctgtgacggcctctgttgccctgtgatctgcaggtccggagagacgcacagctaagatgtcaggacatcctggaagctgggaaagggtcttgccatctctaagctggacctggtgacctttttggagggaaagaaagagccctggactgtgaagagtgaggagaccatagctgcacagccagagatggggttccatcatgttttccaggctgatctcaaactcccacggtcaagcgatctgctggcctcggcctctcaagtccagatgtataatctcatccctgaacatttctgatggtgtgattatgacatgtgactttatctggcaacagagtgagttgttgctcccgcctgagcccagcccccagaaaggattgtgacatatcgttggacccagaattgagcgccggctcatggagatgggattttccaga

SEQ ID NO: 288282 - DNA, 387 bp, Homo sapiens
actttttattaaaaaacaggtcttgccatctctaagctggacctggtgacctttttggagggaaagaaagagccctggactgtgaagagtgaggagaccatagctgcacagccagagatggggttccatcatgttttccaggctgatctcaaactcccacggtcaagcgatctgctggcctcggcctctcaagtccagatgtataatctcatccctgaacatttctgatggtgtgattatgacatgtgactttatctggcaacagagtgagttgttgctcccgcctgagcccagcccccagaaaggattgtgacatatcgttggacccagaattgagggggcattgtgtcatatcgctgggccccacacataggttatgtgactctt

SEQ ID NO: 288283 - DNA, 306 bp, Homo sapiens
  misc_feature (50)..(50): n is a, c, g, or t
  misc_feature (64)..(64): n is a, c, g, or t
ggattttctgacagcttaaaaaaatattggacagttccttatgctgaatnattcacaaggcccnattaaccactacccccagatctatttttagccagcctcgacctccctgggctcaggtgattcttctgtttcagacaccctgcttccttagtaactgggactaaaggtatacggcaccacactggcacattattttgcatatcttgctttttatttttgtagagatggttggccaggctggtcttgaactcctgacctcaggtgatctgcccaccttggcctcccaaaatgctgggattatag

SEQ ID NO: 288284 - DNA, 1046 bp, Homo sapiens
atggttctcgccagtgcagtaccgcttaggtccaccagaaaagctcaatgatggctcactgtgccctccaccttcctgggctcatccaggtgatcctcccattttggcctcccaaatagctggggatctggggatagttctgtgttttgtttgtttgtttttttctatccccactttgagtttgtttccacagtacattgagttttgttggtttttgttttttgggttttttttccctctctctctcatgctccttcctgtacactgcagttgctgttgttttagatttctttcacctaggcttaagtgcagttacttgatcacagctaactacagcctcgacctccctgggctcaggtgattcttctgtttcagacaccctgcttccttagtaactgggactaaaggtatacggcaccacactggcacattattttgcatatcttgctttttatttttgtagagatgagatggggttccatcatgttttccaggctgatctcaaactcccacggtcaagcgatctgctggcctcggcctctcaagtccagatgtataatctcatccctgaacatttctgatggtgtgattatgacatgtgactttatctggcaacagagtgagttgttgctcccgcctgagcccagcccccagaaaggattgtgacatatcgttggacccagaattgagcacctgagtgatctgactgtcttgcctaagaccagcccacagatggaatagtgacacacagctgaacccagaactgaggggatgtgattctatttttctgcattggtgctgctcacaggggacattgtgacatatcgctggaccttacacttaaatgatttgagtctcctcccctgccttggcactgcctacggaaggcattgggacatgtctgtgagccctatgcccaggttatgtgactctcctgcctgttccccgaccacataagcaattgtgacatattgctgggtttgacaccctggtaatgtaactctactgccaaaaaggagcattatgacatatatttccattcatta

SEQ ID NO: 288285 - DNA, 1206 bp, Homo sapiens
gggaaatgttaaacaggaacgattttctaaaaacaaggtgatactctacactttgcacatggcactttgaatgtaaaatgtttttctagaagtgaagaacgggtatttgctggggagagaaatccagatgatgttttcccagtttgtgggaatctcatgagaaggtgtgtgtgctgccgtttaggtgttctcttttttttttttttcctgttcggcttcttcaccaagccactgggtagcatttttgcttcgatgccttgttcctcttttatgccttctaggccagtgcttctcatcttgaaaggggatgtgatggcttccaggcacatgggaccaactccttgctccggtctgaaaagacacacgtcgccttcccttcccggaagctcgcaggcctctgtgcctcctgggctggttctcaagcccaggacagtgccaagaggatgagccccaggccttctgcacagcaagacccctggactcccccaccatggagccctggggcgggctggtctgcagagcagcggcctgggacctgcactttaagaagcgctgtctgatttgagtggtgcttaacaaagcagtatgaggaaggagcaatgacaggggaggactcatggtcaagccacacagcaggggcaggaagcccgcggcccttgctgtgagaagagctcagatcattttcacgtgctgctgtgacaggcagaggaggcttaagaataataggagttttggaagacagatttgatggcatacccaatataagaaatggattatgagtaggtgtaaaattgtcatctttactctctgtgtgctttcagtttactcaaggtcttaggcaatgtcttaactacaattccagtttttctctctctgagaatggattgctttggctggggattactcacggtgaacttgctttgcggggagagttgccgactgtcttaattacattttgaaaaacacaacaacttggggttaaactggagaagttaatgatgaatgcagtctggggttcttccccggctgccttcccctgcagccgccctggaggaggctggctggctcgctcgctcaggagtcctcagcgattcttctttattcagacaaagggacctaaactctgcagccaatgttgcaggacccaagtggtctgtctctgccaccacctcctgctcccgatggcaaataaacaggacaaaagga

SEQ ID NO: 288286 - DNA, 3124 bp, Homo sapiens
  misc_feature (1045)..(1045): n is a, c, g, or t
  misc_feature (2409)..(2409): n is a, c, g, or t
  misc_feature (2422)..(2423): n is a, c, g, or t
gggaaataaagtccaagaggtcagcaggcaccagaagccatagccttagttggggcatcaggagagcagcaagctgcatctaccttggaaagatggagagaagactgcagtgagcggagtggggaggaagggggaagtggcagggcagaggaagcagggtacagacaggagaaaagagatggtgccctgggccaggtggctgccaccgctaccatcgccagaagtggaaaactctttgccttctccttaccactgtcactatgacaccccaattctttctgctcccccttctttagtaataggtgctggcaagtaaggagcagtctgatttgagtttgcgaaggaaacccttggaggtagctgtgaacccatgaggcttgccaagtagggagctcaggatccccaagattggatgaggaaataagcttagtgagtgacagttccaccagccttccccagagtcacagtaggcgtccactgcccctgcgggtccccaggcctgctctactgggtggcctctcggacccagggctgcacttccaatgctctgcagacacatctcgggcttgaatcccatctcactgattccacaaatattgactgagggcctactggatgcgagacctgtgtggctgtgggggaggcaaggtccctgcttcagtgggagtgacaggtgtaaagcaggatgatttcagaacctgagaagggggacaaagcagagaactgggaagtggctgggcgggtgcggtgcagcctgggatggggtaaacagcaaatctttgccatctgttcctgtccggatatcatggaaaatgctacccgatctctcttgcacctcagtgtcctcagctggttggtagagtttgagcttccccactgcctgaccctgctctctgggctgtctctagggagtctgcccttctcaggcctgctccccaccctctatggctctcaattcctcccaagaagaatgttcctctaaaaggaggccgctggccacaaagggagatgaacaagccaaggtagcctggcctgcacttggggncacatggctccttaggcccggcctgggtggacactggaaggagctttgtctgtgggttttgccctgttgcctggagccccttccctatggtgtcttgactcagcccagctcgctgagcctggagcccaggcttctagagaagagatgtcaaggtctaccacagggcacaggccagaaacaacttgtccgatgccagtgaaagccaggcctggggaaggctcctcttctcacagggctggcactcccagaggggacacggcacggcagcaagttggaggcacagactctgaggggcccttggtggggagctcaaacaggacccacagggaccctctctctggggttgcaaactggcactgggtggagggagattcagtattgacacctgggggaccctcaaccccaaagtggatttaaaggacagtggcacactggggagacaagaggctccacaacactcccatgcttgccccagcctgcttcttgcttcccgttcctgctctttgttggggaaggagaatcttatatgactggttgaactccaggatagtccctgaccaccatcagtagtgggcagggtcaccatatgttcaaggctgtgcacaccgagccactggccatgcacatgggcggggccttctggaccttcatcaggccccttaggaacccatgaagaagctccctgataggtgctgatgggcatctgcacccatagattcactgcctgaaatggaaacactgggttcctgggaaactggaacctgccttatgaaagcccccattcccatcaccccctccatccctcggggctgctgctgtgtcttgccatcaaccctccccagacccccaggacacctgcctcacccagaagcaccccttcaacctgggcctcgatgaaggctcactcctccgtcaggcctctgaggggggatggctccgtgccacttttagcaaaaggggaaaccatcgcagcagaaaggccaatgccacactagacagccaggagcccagcagaacaagtggccccctaaggcactttggggaccacacccccgtcactctgaccccagcacaactggttcccaggccttcgggatcctcctgggaacctctcagcatgattaacacaggcagacgggacctgaaggggccgctggtccttctgaaaatgttcaccaggcagtgtgagtgtggagaggccatgcgcaatgtgtgggactctgccctgcacccactcagagcctcagcccttcagagccactaataatgatttgctgtgggtggggtcatcctgatacttccctgaggtctcttttcctttcaatttttctgagtaactgagaggatcatatgactgcatgccncctaaactagggnntgcacagccccctttctgtgcagggagggcgcaaagcagcagagtgtctgtgacccacctgccacttttccaatgctactacaagatttgcaggaaacggtcatttatcaggagccatctttattaaaaaagataaaatagagcagggcaggggaaaagcgctgcaggctccaacgttgctgggcacgtggcagcatgggcgtctcaccaggctcctccccacagctgttggcatccactgtcaggtttcaatgttcttggacctcagggccttcgtcctctccaatctaaatgcagggagacatttgatatggactctctcaggtgttttgcaaaacgcaacacattctcattgatctggtcaccctgctgtgcactagatgtcaaaagctcttcctccagtccagactttggtcctttaaccgacaaccccccattccctccctctgtcactctccagccccagttcaacatcgatctacttgctacttctatggggtcaactttttcagatcaacacttccaggacatcatgtggaattggtctctctgagatggtggagatgctgagtagcgggatttcctcattccacggtgcacacatctatcgaatcctcacattgtaccccataagtgtacaagcatgatttgccaattaaaataatactaataaagacataataaataccataaaatgcagg

SEQ ID NO: 288287 - DNA, 812 bp, Homo sapiens
ggtgagttcccaggttcatcgtgccctgtttccgttcgcaaaattaaggaaagatgttcagacaccgtcgcctggccgttcatacacaaaacaactcgcgctgtgtgctgccccacttcctgccacttcactaatggccgcccattacccatttgttgactgtcagctccaaacctccccgtccttccctcgctgtgtgaggacaaggctgaactccgtgtcatttgccagctggccagtacccttcagcccagatctctatgccaagcagtctgaaatccttctgagcaaccactacaccacctccgaggtcagggtctttggtgtcccagaggttctggagaacttggaggcattgtgaagaccctgtttctctagctgtgcagctgcaaggtcactagacagataaactcaagttgcaaaacacgttttcctagaaaaccccaggcctccattctgcttgctgcagccgctggaaccacagatgctccctggcagggccaccataccctccagcaccagctcctcacctcatgcctctcaggcagatttggatcatctgcctggccagccccagttcaacatcgatctacttgctacttctatggggtcaactttttcagatcaacacttccaggacatcatgtggaattggtctctctgagatggtggagatgctgagtagcgggatttcctcattccacggtgcacacatctatcgaatcctcacattgtaccccataagtgtacaagcatgatttgccaattaaaataatactaataaagacataataaataccataaaatgcagg

SEQ ID NO: 288288 - DNA, 633 bp, Homo sapiens
ggtgagttcccaggttcatcgtgccctgtttccgttcgcaaaattaaggaaagatgttcagacaccgtcgcctggccgttcatacacaaaacaactcgcgctgtgtgctgccccacttcctgccacttcactaatggccgcccattacccatttgttgactgtcagctccaaacctccccgtccttccctcgctgtgtgaggacaaggctgaactccgtgtcatttgccagctggccagtacccttcagcccagatctctatgccaagcagtctgaaatccttctgagcaaccactacaccacctccgaggtcagggtctttggtgtcccagaggttctggagaacttggaggcattgtgaagaccctgtttctctagctgtgcagctgcaaggtcactagacagataaactcaagttgcaaaacacgttttcctagaaaaccccaggcctccattctgcttgctgcagccgctggaaccacagatgctccctggcagggccaccataccctccagcaccagctcctcacctcatgcctctcaggcagatttggatcatctgcctggccaggtaggcctgcaagcctatggcccctgggaaagatataataaatgccgttggctttgatttgc

SEQ ID NO: 288289 - DNA, 399 bp, Homo sapiens
gccaccaacggtatttctatgatctacctactatggagctgaaaagtaaagatggaaataagcctatctacaaacaggatgctctctatcaagagtcatgagaattgtcttcagagggtgctgaagagacatcaacctgtcttctttgagactcctagtgttggtgtggaagatgctactggagacaacaggttcctccaggcctgattgcttggtcaattgtgttctcccaggaattcattcctttttgcttcatatgtctcctgaagactattgaaaatccacaaacgaaggacagcatcatgaaattgtatactaagaaatttcagttcacataatttctacctatctactttcaaaacatagataaagctgctgcttgccagatcaaagcataag

SEQ ID NO: 288290 - DNA, 542 bp, Homo sapiens
gccaccaacggtatttctatgatctacctactatggagctgaaaagtaaagatggaaataagcctatctacaaacaggatgctctctatcaagagtcatgagaattgtcttcagagggtgctgaagagacatcaacctgtcttctttgagactcctagtgttggtgtggaagatgctactggagacaacaggttcctccaggcctgattgcttggtcaattgtgaatcacctttgatgaaacatactccggcataagataagccagcgtgtggcacctggcatttcattaaacaattgcactgacttagaggatgcccaggaacccagaccactacatacaccaaatctcttttctgaaaatccatggagaaatttttccaggtaaagctgtgtttcatctggagcaatcattttgtttttactttatagatactataaatctgtcgtatgttaaactttttgcttgtgtttagcatataacacatgctcactaaatatctgctaatgaatgagtgaattaataaattttctccatgctctg

SEQ ID NO: 288291 - DNA, 1382 bp, Homo sapiens
gtttgccctctagggtagaatccgccaagctttgagagaaggctgtgactgctgtgctctgggcgccactcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaatgaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgata

SEQ ID NO: 288292 - DNA, 2673 bp, Homo sapiens
gtttgccctctagggtagaatccgccaagctttgagagaaggctgtgactgctgtgctctgggcgccactcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctggtcagtggaggaaggccccagggtggacctgggagggccaggacggatgaaatctgctttcaggcagaggtttgcaggaaaggggggtggcctgcttactgggaagtatcgctgtgagttgcctcagcacatatcagtggttgtttttgcctcagttctgattgaacagaagaaggtttcaaggccaaaaacaggcagccaagtgtgagagaagcagaaggaaatccctactgcataaaacccatttccattttaatggcagaattgaaaagcacagaccacaactgaatcctagccctggaaatgactcactatacaacatgatgaattcatttaacccttgagtttccatttcttcacctgctccgtggggcactaacgcctccctcagaggcttctggtgagaatcagtgtttccctgcccccgccccgccctccatgccccttctccacgttctcactgtgctaggtgctcttctctgtctttctcttccaccagcctgtgggaaacctgagatgaaagtcgtgtcttacccatctttgtatttccagcatctgaaactgggcagagcttaataaatattttgctggagaggttgatgatcttacaaagctcccattgaaaggtggctctctgtaaagcaaagttacaatgagattgtgatgaacattgtccttgtggcttttcacttagtcccctcccttcacctgaagagcaaattttcctcaaaagtacacagcaaacgaatgacccactggtgacactgttgcctttagaccctgctggaaagaagctccacatttattaacattcccgaagtaaatttatcaggtagcattcatcaggtaacatttgttgcacattcatgacttttctactgtccacaaaggcatatgtccttatcatatgcggactcctcggtcacactggattcttccttccctcctcgacatggaagagatggcatcttagggtctcttgtgttcttcctgcagaggcctgtcgggcaggaaaaggctgcagctgccttcctgggagaaggaggagatgagtgtatcctgaacacctattatgtgctaggggctattgtagatacatgacactatcatgctcattttcacgaatgaggaaactgaggctcagaagacttaaattatttgcccaagagttataaatgacagagccagcattagagtccaggactgtctgatttcagacctaagctgttccctctgcacatcgtgtcccaccagtaaggaagatctgggtctcagagctgagccaagacctcccgggtcctctgcggttttttgtgtctttcagagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcaggtttgtagctcctcccggtcccttttgttatcagtttccacttggcccaggccctaaccccagacattgccagaatccctctctttgggctagatacacattcagatctaggcccgtattgtattatagtcattcattcgtttattagatcattcatttgacaagacttgaacaaactagcttatgtgtcagccaatgcgtgagacatggtgggtgatgccaagagaagtccagtccctgcccttggggagttctcagcattgtgaggaagacagggtcattataataagatgggataagagcaatgatagggacatgaaaagcctaggatagaagtacagaggaggctccatagcccaacaagggctgaggcagttggagaaggtcttggggagagcagtgtagtgtagtgatggagtgcacatagtggggccagactgccttggttcaaatctagttctacagcataccaactatatgacccaagtgagtcactccacctctc

SEQ ID NO: 288293 - DNA, 2327 bp, Homo sapiens
gtttgccctctagggtagaatccgccaagctttgagagaaggctgtgactgctgtgctctgggcgccactcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaatgaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaacattctgtttaccttttcaaggctgtattggttggagtgtagactgaactgcctggggtctgtttctcttcagtgatgagactcttaggaaggcaggaatggataggatagggggaggagaggagagatggggatttagaatgtagagtgagtgccccttttcttaaaactgaatacagtcacgcaccacataatgatgtttagttcaacaacagactgcatatatgatggtgatcccataaaattataataccatatttctattgtaccttttctattcctatgtttagatatatgagtacttaccattgtgttacaattgcctaaagtattcagtacagtagcatgctgtacaggtttgtagcctaggggcaataggctatacgctacagcctaggtgtgtagtaggccacaccatttaggtttgtataagtacctgctatgatgttcacacaacaaaattgcctgcatttctcaaaatgtatccccatatttcaacaatgcatgactgtactcttctgccaatgaccttgtattcttgtttccatgtcttcttctctttcctcctatggcaaataaaacactgttttgcaacacaaaaagagaaaaaaaaaaaaacaaaaaaaaaatttgttgggaggctttgggccttcgaaaaagttttttataaaccattctggtttggggcggggggcccgtatgggttaagtgtgaaccggtgcccacgaggtgtgttacccctgagaaaactcggggccaggaaccaatgcgcgggagactccgtccccactcaaaaacccccgcgggtcacacccggacggtttgcgacaaatcccgatggccttcccgaggcccaacggggatc

SEQ ID NO: 288294 - DNA, 2384 bp, Homo sapiens
gtttgccctctagggtagaatccgccaagctttgagagaaggctgtgactgctgtgctctgggcgccactcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagctctcccaggataccctgagtgcagggaaatgggagagaccctccctgagaaaccagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaatgaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaacattctgtttaccttttcaaggctgtattggttggagtgtagactgaactgcctggggtctgtttctcttcagtgatgagactcttaggaaggcaggaatggataggatagggggaggagaggagagatggggatttagaatgtagagtgagtgccccttttcttaaaactgaatacagtcacgcaccacataatgatgtttagttcaacaacagactgcatatatgatggtgatcccataaaattataataccatatttctattgtaccttttctattcctatgtttagatatatgagtacttaccattgtgttacaattgcctaaagtattcagtacagtagcatgctgtacaggtttgtagcctaggggcaataggctatacgctacagcctaggtgtgtagtaggccacaccatttaggtttgtataagtacctgctatgatgttcacacaacaaaattgcctgcatttctcaaaatgtatccccatatttcaacaatgcatgactgtactcttctgccaatgaccttgtattcttgtttccatgtcttcttctctttcctcctatggcaaataaaacactgttttgcaacacaaaaagagaaaaaaaaaaaaacaaaaaaaaaatttgttgggaggctttgggccttcgaaaaagttttttataaaccattctggtttggggcggggggcccgtatgggttaagtgtgaaccggtgcccacgaggtgtgttacccctgagaaaactcggggccaggaaccaatgcgcgggagactccgtccccactcaaaaacccccgcgggtcacacccggacggtttgcgacaaatcccgatggccttcccgaggcccaacggggatc

SEQ ID NO: 288295 - DNA, 2283 bp, Homo sapiens
gtttgccctctagggtagaatccgccaagctttgagagaaggctgtgactgctgtgctctgggcgccactcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaatgaccgactgcaccttctgtgcttcagctcttcttgacatcaaggctcttccgttccacatccacacagccaatccaattaatcaaaccactgttattaacagataatagcaacttgggaaatgcttatgttacaggttaaatagactaacctctaccagcacattaaaagtgattgtttctgggtgataaaattattgatgatttttattttctttatttttctataaagatcatatattacttttataataaaacattataaaaacaacattctgtttaccttttcaaggctgtattggttggagtgtagactgaactgcctggggtctgtttctcttcagtgatgagactcttaggaaggcaggaatggataggatagggggaggagaggagagatggggatttagaatgtagagtgagtgccccttttcttaaaactgaatacagtcacgcaccacataatgatgtttagttcaacaacagactgcatatatgatggtgatcccataaaattataataccatatttctattgtaccttttctattcctatgtttagatatatgagtacttaccattgtgttacaattgcctaaagtattcagtacagtagcatgctgtacaggtttgtagcctaggggcaataggctatacgctacagcctaggtgtgtagtaggccacaccatttaggtttgtataagtacctgctatgatgttcacacaacaaaattgcctgcatttctcaaaatgtatccccatatttcaacaatgcatgactgtactcttctgccaatgaccttgtattcttgtttccatgtcttcttctctttcctcctatggcaaataaaacactgttttgcaacacaaaaagagaaaaaaaaaaaaacaaaaaaaaaatttgttgggaggctttgggccttcgaaaaagttttttataaaccattctggtttggggcggggggcccgtatgggttaagtgtgaaccggtgcccacgaggtgtgttacccctgagaaaactcggggccaggaaccaatgcgcgggagactccgtccccactcaaaaacccccgcgggtcacacccggacggtttgcgacaaatcccgatggccttcccgaggcccaacggggatc

SEQ ID NO: 288296 - DNA, 1439 bp, Homo sapiens
gtttgccctctagggtagaatccgccaagctttgagagaaggctgtgactgctgtgctctgggcgccactcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagctctcccaggataccctgagtgcagggaaatgggagagaccctccctgagaaaccagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaatgaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgata

SEQ ID NO: 288297 - DNA, 3651 bp, Homo sapiens
gtttgccctctagggtagaatccgccaagctttgagagaaggctgtgactgctgtgctctgggcgccactcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctggtcagtggaggaaggccccagggtggacctgggagggccaggacggatgaaatctgctttcaggcagaggtttgcaggaaaggggggtggcctgcttactgggaagtatcgctgtgagttgcctcagcacatatcagtggttgtttttgcctcagttctgattgaacagaagaaggtttcaaggccaaaaacaggcagccaagtgtgagagaagcagaaggaaatccctactgcataaaacccatttccattttaatggcagaattgaaaagcacagaccacaactgaatcctagccctggaaatgactcactatacaacatgatgaattcatttaacccttgagtttccatttcttcacctgctccgtggggcactaacgcctccctcagaggcttctggtgagaatcagtgtttccctgcccccgccccgccctccatgccccttctccacgttctcactgtgctaggtgctcttctctgtctttctcttccaccagcctgtgggaaacctgagatgaaagtcgtgtcttacccatctttgtatttccagcatctgaaactgggcagagcttaataaatattttgctggagaggttgatgatcttacaaagctcccattgaaaggtggctctctgtaaagcaaagttacaatgagattgtgatgaacattgtccttgtggcttttcacttagtcccctcccttcacctgaagagcaaattttcctcaaaagtacacagcaaacgaatgacccactggtgacactgttgcctttagaccctgctggaaagaagctccacatttattaacattcccgaagtaaatttatcaggtagcattcatcaggtaacatttgttgcacattcatgacttttctactgtccacaaaggcatatgtccttatcatatgcggactcctcggtcacactggattcttccttccctcctcgacatggaagagatggcatcttagggtctcttgtgttcttcctgcagaggcctgtcgggcaggaaaaggctgcagctgccttcctgggagaaggaggagatgagtgtatcctgaacacctattatgtgctaggggctattgtagatacatgacactatcatgctcattttcacgaatgaggaaactgaggctcagaagacttaaattatttgcccaagagttataaatgacagagccagcattagagtccaggactgtctgatttcagacctaagctgttccctctgcacatcgtgtcccaccagtaaggaagatctgggtctcagagctgagccaagacctcccgggtcctctgcggttttttgtgtctttcagagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaatgaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaacattctgtttaccttttcaaggctgtattggttggagtgtagactgaactgcctggggtctgtttctcttcagtgatgagactcttaggaaggcaggaatggataggatagggggaggagaggagagatggggatttagaatgtagagtgagtgccccttttcttaaaactgaatacagtcacgcaccacataatgatgtttagttcaacaacagactgcatatatgatggtgatcccataaaattataataccatatttctattgtaccttttctattcctatgtttagatatatgagtacttaccattgtgttacaattgcctaaagtattcagtacagtagcatgctgtacaggtttgtagcctaggggcaataggctatacgctacagcctaggtgtgtagtaggccacaccatttaggtttgtataagtacctgctatgatgttcacacaacaaaattgcctgcatttctcaaaatgtatccccatatttcaacaatgcatgactgtactcttctgccaatgaccttgtattcttgtttccatgtcttcttctctttcctcctatggcaaataaaacactgttttgcaacacaaaaagagaaaaaaaaaaaaacaaaaaaaaaatttgttgggaggctttgggccttcgaaaaagttttttataaaccattctggtttggggcggggggcccgtatgggttaagtgtgaaccggtgcccacgaggtgtgttacccctgagaaaactcggggccaggaaccaatgcgcgggagactccgtccccactcaaaaacccccgcgggtcacacccggacggtttgcgacaaatcccgatggccttcccgaggcccaacggggatc

SEQ ID NO: 288298 - DNA, 2363 bp, Homo sapiens
gtttgccctctagggtagaatccgccaagctttgagagaaggctgtgactgctgtgctctgggcgccactcgctccagggagtgatgggaatcctgtcattcttacctgtccttgccactgagagtgactgggctgactgcaagtccccccagccttggggtcatatgcttctgtggacagctgtgctattcctggcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagctctcccaggataccctgagtgcagggaaatgggagagaccctccctgagaaaccagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaatgaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaacattctgtttaccttttcaaggctgtattggttggagtgtagactgaactgcctggggtctgtttctcttcagtgatgagactcttaggaaggcaggaatggataggatagggggaggagaggagagatggggatttagaatgtagagtgagtgccccttttcttaaaactgaatacagtcacgcaccacataatgatgtttagttcaacaacagactgcatatatgatggtgatcccataaaattataataccatatttctattgtaccttttctattcctatgtttagatatatgagtacttaccattgtgttacaattgcctaaagtattcagtacagtagcatgctgtacaggtttgtagcctaggggcaataggctatacgctacagcctaggtgtgtagtaggccacaccatttaggtttgtataagtacctgctatgatgttcacacaacaaaattgcctgcatttctcaaaatgtatccccatatttcaacaatgcatgactgtactcttctgccaatgaccttgtattcttgtttccatgtcttcttctctttcctcctatggcaaataaaacactgttttgcaacacaaaaagagaaaaaaaaaaaaacaaaaaaaaaatttgttgggaggctttgggccttcgaaaaagttttttataaaccattctggtttggggcggggggcccgtatgggttaagtgtgaaccggtgcccacgaggtgtgttacccctgagaaaactcggggccaggaaccaatgcgcgggagactccgtccccactcaaaaacccccgcgggtcacacccggacggtttgcgacaaatcccgatggccttcccgaggcccaacggggatc

SEQ ID NO: 288299 - DNA, 2437 bp, Homo sapiens
gtttgccctctagggtagaatccgccaagctttgagagaaggctgtgactgctgtgctctgggcgccactcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagccaatcccactaatcctgatgaggctgacaaagttggggtgagtgatcccagccatctccccctcccttctcccctgttgccttttctgttgccttctttcctaggccctctctgtggatccttactgctggtttctgccttctctaggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaatgaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaacattctgtttaccttttcaaggctgtattggttggagtgtagactgaactgcctggggtctgtttctcttcagtgatgagactcttaggaaggcaggaatggataggatagggggaggagaggagagatggggatttagaatgtagagtgagtgccccttttcttaaaactgaatacagtcacgcaccacataatgatgtttagttcaacaacagactgcatatatgatggtgatcccataaaattataataccatatttctattgtaccttttctattcctatgtttagatatatgagtacttaccattgtgttacaattgcctaaagtattcagtacagtagcatgctgtacaggtttgtagcctaggggcaataggctatacgctacagcctaggtgtgtagtaggccacaccatttaggtttgtataagtacctgctatgatgttcacacaacaaaattgcctgcatttctcaaaatgtatccccatatttcaacaatgcatgactgtactcttctgccaatgaccttgtattcttgtttccatgtcttcttctctttcctcctatggcaaataaaacactgttttgcaacacaaaaagagaaaaaaaaaaaaacaaaaaaaaaatttgttgggaggctttgggccttcgaaaaagttttttataaaccattctggtttggggcggggggcccgtatgggttaagtgtgaaccggtgcccacgaggtgtgttacccctgagaaaactcggggccaggaaccaatgcgcgggagactccgtccccactcaaaaacccccgcgggtcacacccggacggtttgcgacaaatcccgatggccttcccgaggcccaacggggatc

SEQ ID NO: 288300 - DNA, 1482 bp, Homo sapiens
  misc_feature (1087)..(1087): n is a, c, g, or t
gtttgccctctagggtagaatccgccaagctttgagagaaggctgtgactgctgtgctctgggcgccactcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagccaattccactgatcctgtgaaggctgcccaatttgagccacctggacgtcaaatgattgccatcagaaagagacaacctgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatctagnttgctgatggatgacaaaaagaggggaattgttaaaggaaaatttaaatggagactggaaaaattcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtggctagggactttctaagaagatacctacccccaaaaaacaattatataattgaaaaccaatcgattgcctttattttgcttccacattttcccaataaatacttgcctgtgacattttgccactggaacact

SEQ ID NO: 288301 - DNA, 1743 bp, Homo sapiens
gcaattccctgaaaagaatgcagctcaagtgactgctccactttttcaccttggcctttgcggaaggctgtggctgggctaccctatgcatcgatcaatgaggtcatatttacccagtgcttggcctagaggcccaagacagggtcagcagtgcttgctttggctctagtttgggcgttggttttgcagcctcagcatcagcacaggcaggccctcttctccagcagtgctctggctgatatttcttctttttcccacagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaatgaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaacattctgtttaccttttcaaggctgtattggttggagtgtagactgaactgcctggggtctgtttctcttcagtgatgagactcttaggaaggcaggaatggataggatagggggaggagaggagagatggggatttagaatgtagagtgagtgccccttttcttaaaactgaatacagtcacgcaccacataatgatgtttagttcaacaacagactgcatatatgatggtgatcccataaaattataataccatatttctattgtaccttttctattcctatgtttagatatatgagtacttaccattgtgttacaattgcctaaagtattcagtacagtagcatgctgtacaggtttgtagcctaggggcaataggctatacgctacagcctaggtgtgtagtaggccacaccatttaggtttgtataagtacctgctatgatgttcacacaacaaaattgcctgcatttctcaaaatgtatccccatatttcaacaatgcatgactgtactcttctgccaatgaccttgtattcttgtttccatgtcttcttctctttcctcctatggcaaataaaacactgttttgcaacacaaaaagagaaaaaaaaaaaaacaaaaaaaaaatttgttgggaggctttgggccttcgaaaaagttttttataaaccattctggtttggggcggggggcccgtatgggttaagtgtgaaccggtgcccacgaggtgtgttacccctgagaaaactcggggccaggaaccaatgcgcgggagactccgtccccactcaaaaacccccgcgggtcacacccggacggtttgcgacaaatcccgatggccttcccgaggcccaacggggatc

SEQ ID NO: 288302 - DNA, 1498 bp, Homo sapiens
  misc_feature (1103)..(1103): n is a, c, g, or t
cagcatttgtgccttgaacagtggttttttttgctggctgtacaggtccggagttcccgggcatctgctgtgctctgggcgccactcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagccaattccactgatcctgtgaaggctgcccaatttgagccacctggacgtcaaatgattgccatcagaaagagacaacctgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatctagnttgctgatggatgacaaaaagaggggaattgttaaaggaaaatttaaatggagactggaaaaattcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtggctagggactttctaagaagatacctacccccaaaaaacaattatataattgaaaaccaatcgattgcctttattttgcttccacattttcccaataaatacttgcctgtgacattttgccactggaacact

SEQ ID NO: 288303 - DNA, 1853 bp, Homo sapiens
gcaattccctgaaaagaatgcagctcaagtgactgctccactttttcaccttggcctttgcggaaggctgtggctgggctaccctatgcatcgatcaatgaggtcatatttacccagtgcttggcctagaggcccaagacagggtcagcagtgcttgctttggctctagtttgggcgttggttttgcagcctcagcatcagcacaggcaggccctcttctccagcagtgctctggctgatatttcttctttttcccacagccaatcccactaatcctgatgaggctgacaaagttggggtgagtgatcccagccatctccccctcccttctcccctgttgccttttctgttgccttctttcctaggccctctctgtggatccttactgctggtttctgccttctctaggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaatgaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaacattctgtttaccttttcaaggctgtattggttggagtgtagactgaactgcctggggtctgtttctcttcagtgatgagactcttaggaaggcaggaatggataggatagggggaggagaggagagatggggatttagaatgtagagtgagtgccccttttcttaaaactgaatacagtcacgcaccacataatgatgtttagttcaacaacagactgcatatatgatggtgatcccataaaattataataccatatttctattgtaccttttctattcctatgtttagatatatgagtacttaccattgtgttacaattgcctaaagtattcagtacagtagcatgctgtacaggtttgtagcctaggggcaataggctatacgctacagcctaggtgtgtagtaggccacaccatttaggtttgtataagtacctgctatgatgttcacacaacaaaattgcctgcatttctcaaaatgtatccccatatttcaacaatgcatgactgtactcttctgccaatgaccttgtattcttgtttccatgtcttcttctctttcctcctatggcaaataaaacactgttttgcaacacaaaaagagaaaaaaaaaaaaacaaaaaaaaaatttgttgggaggctttgggccttcgaaaaagttttttataaaccattctggtttggggcggggggcccgtatgggttaagtgtgaaccggtgcccacgaggtgtgttacccctgagaaaactcggggccaggaaccaatgcgcgggagactccgtccccactcaaaaacccccgcgggtcacacccggacggtttgcgacaaatcccgatggccttcccgaggcccaacggggatc

SEQ ID NO: 288304 - DNA, 1444 bp, Homo sapiens
  misc_feature (1049)..(1049): n is a, c, g, or t
gtttgccctctagggtagaatccgccaagctttgagagaaggctgtgactgctgtgctctgggcgccactcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagccacctggacgtcaaatgattgccatcagaaagagacaacctgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatctagnttgctgatggatgacaaaaagaggggaattgttaaaggaaaatttaaatggagactggaaaaattcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtggctagggactttctaagaagatacctacccccaaaaaacaattatataattgaaaaccaatcgattgcctttattttgcttccacattttcccaataaatacttgcctgtgacattttgccactggaacact

SEQ ID NO: 288305 - DNA, 1529 bp, Homo sapiens
  misc_feature (1134)..(1134): n is a, c, g, or t
gtttgccctctagggtagaatccgccaagctttgagagaaggctgtgactgctgtgctctgggcgccactcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaaggccccagactaaggacggcagcgaagcagagctccctcgttggtgcagaggttccctaagctcctgggcattcgtaagaactgagctcccagctcttcaccgatggggatcattgtggctgtggtcactgggattgctgtagcggccattgttgctgctgtagtggccttgatctactgcaggaaaaagcggatttcagccacctggacgtcaaatgattgccatcagaaagagacaacctgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatctagnttgctgatggatgacaaaaagaggggaattgttaaaggaaaatttaaatggagactggaaaaattcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtggctagggactttctaagaagatacctacccccaaaaaacaattatataattgaaaaccaatcgattgcctttattttgcttccacattttcccaataaatacttgcctgtgacattttgccactggaacact

SEQ ID NO: 288306 - DNA, 795 bp, Homo sapiens
gtttgccctctagggtagaatccgccaagctttgagagaaggctgtgactgctgtgctctgggcgccactcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaaggtatgaggagtctgccaagatgtagggaggggagaagaggggatggacaagggctgaggtcacat

SEQ ID NO: 288307 - DNA, 1567 bp, Homo sapiens
  misc_feature (1172)..(1172): n is a, c, g, or t
gtttgccctctagggtagaatccgccaagctttgagagaaggctgtgactgctgtgctctgggcgccactcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaaggccccagactaaggacggcagcgaagcagagctccctcgttggtgcagaggttccctaagctcctgggcattcgtaagaactgagctcccagctcttcaccgatggggatcattgtggctgtggtcactgggattgctgtagcggccattgttgctgctgtagtggccttgatctactgcaggaaaaagcggatttcagccaattccactgatcctgtgaaggctgcccaatttgagccacctggacgtcaaatgattgccatcagaaagagacaacctgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatctagnttgctgatggatgacaaaaagaggggaattgttaaaggaaaatttaaatggagactggaaaaattcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtggctagggactttctaagaagatacctacccccaaaaaacaattatataattgaaaaccaatcgattgcctttattttgcttccacattttcccaataaatacttgcctgtgacattttgccactggaacact

SEQ ID NO: 288308 - DNA, 1005 bp, Homo sapiens
ggacttccgtttcggtccagccgggctgcggccattgtttgtgtggactgagtgttttggccatcccggtccactctcacaggctccgttaagtgacatgaactctcaggaggactgagccagaagcggacagggcaagacgagctgtgcttgaaggaagaggggcagaaaatcgagggtcagggactgagaagctactccggtttagaaaccccagagacacccgtgtagatgggtacatcacggcttctctcccacgttaagacttaataaaggaacctacctttgatcagcaaggaaggactggggtggcaaaggctcatgcccccattttacagatgtcatcatttgtcccaacatcattgattgaataagccatcttttccccacaaatttgatgtaacctttgtcatgtgtaaaatgcactgttgtacttgtgtccatttctggatttgtacccgtttccattgatcttctctacttctatgtcaagccatgttatgaattgcagagtccttattaaagttttaatatgccattgaattagcctctcctcattattccactttcaaaatggttttctttcaaaagcatttgaaaatcagtttgttacagctcctccaaccccacatcaaaatcaagattaatatcttgattaaatctgcttgaaaatagagataagtttagttagaacaaaattatatttatttctcctaagactgagcagagtcatcttgttttttcaagcctatttgttgttgttgttgtttttgttgttgttttgagacagagtcatcttgctctgttgcccaggctggagttcagtggcacactcttggctcactgcaacctctgtctcccaggttaaagtgattctcatgcctcagctactcaggaggctgaagcaggagaattgcttgaacccgggaggctgaagttgcagtgagccaggatggcaccactgcactccaacctgggcaacagaggaagactccctctaaaaaa

SEQ ID NO: 288309 - DNA, 2665 bp, Homo sapiens
ggacttccgtttcggtccagccgggctgcggccattgtttgtgtggactgagtgttttggccatcccggtccactctcacaggctccgttaagtgacatgaactctcaggaggactgagccagaagcggacagggcaagacgagctgtgcttgaaggaagaggggcagaaaatcgagggtcagggactgagaagctactccggtttagaaaccccagagacacccgtgtagatgggtacatcacggcttctctcccacgttaagacttaataaagaaagcctgatctttgaccagatggcagtaacatttgaagatgtgactattatttttacatgggaggagtggaaattcctggattcttctcaaaaaagactctacagggaggtcatgtgggagaactacacaaatgtcatgtcagtagaaaactggaatgagagctacaaatcccaagaagaaaaattcagatacttagaatatgaaaatttttcctactggcaaggctggtggaatgctggcgcccagatgtatgagaatcagaactatggggaaactgttcaagggacagattccaaagacctcacacagcaagatcgttcccagtgtcaggaatggttaatactctccacacaagtaccagggtatgggaactatgaactgacttttgaaagcaaaagtctcaggaacttaaaatataaaaattttatgccttggcagtccttagaaacaaaaaccactcaagactatggtagagaaatctacatgagtggttcacatggttttcaagggggcagataccgtcttggcatatccaggaaaaacctctccatggaaaaagaacagaagctcatagttcagcattcttatatcccagtggaggaagcccttccacagtatgttggggtgatatgtcaagaagacctactgagagattcaatggaagaaaagtactgtggatgtaataaatgtaaaggaatttattattggaactcacggtgtgttttccacaagagaaatcaacctggagaaaacctctgtcaatgctccatccgtaaagcatgcttctctcagagatcagacttgtatagacatccaagaaaccacataggtaagaagctgtacggatgtgatgaagttgacggtaactttcatcagagctccggagttcactttcatcagagagttcacataggggaggtaccttatagctgtaatgcatgtggtaagagcttcagccagatctctagtcttcacaatcatcaaagagtccacacagaagagaaattctataaaattgagtgtgataaagacctcagtagaaattcattacttcacattcaccagagacttcacataggagagaagccttttaaatgtaatcagtgtggtaagagttttaatcggagttcagtacttcatgttcatcagagagtccacacaggagaaaaaccatataagtgtgatgagtgtggtaagggtttcagccagagctcaaatcttcgaattcatcagttagtacacacaggagagaagtcttataaatgtgaagactgtggtaaaggctttacccagcgctcaaatcttcaaattcatcagagagtgcatacaggagagaaaccttataaatgtgatgactgtggaaaggactttagtcacagctcagatcttcgcattcatcagagagtccatacaggggagaaaccctatacttgtcctgaatgtgggaagggcttcagtaagagttcaaagcttcacactcatcaaagagtacatactggagagaaaccctacaaatgtgaagagtgtggcaagggattcagtcagcgttcacatcttctcattcatcagagagtccatacaggagaaaagccctataaatgtcatgattgtggaaagggttttagtcacagttctaatcttcacattcatcagagggtccatacaggagagaagccttatcaatgtgctaagtgtggtaaaggtttcagtcatagctcagctcttcgaattcatcaaagagtccatgcaggagagaaaccttacaaatgccgtgaatattataagggatttgatcataattcacatcttcacaataatcatagaagaggaaacttataaatattgttcatttagttaacagctttaatcaaagtttacctaacctttaaaccctataaatcctgctgttaaggaaatcttataaataacacaagtaatcccaagcaacatttatagtttcccctatctcccactaagaattatttgcttcaaaaggagatctttagaaaaaaccctatatatttaaaattatagtgtatttttctttacctactataaatataatacagtcataaatatattaaacatttaaggagaaaactcttcattctatttcattctagtctttttttctgtgcattttaatgtgcatgaaattatattgtgtgttcaattttgtattttcactgtcttcaaaatatttacttaaattttggtttgaattgaaactggttggccaactgttaaacaacatctcttaactcccctaaaaactccctaggaagtaacagaaaagatggaaacacacagaacttaaaactcagttttggccggtagaattcaattgtttatggacaaaagccacctaataaaagataggaaagcatt

SEQ ID NO: 288310 - DNA, 481 bp, Homo sapiens
ttcttctttgcagcaaaacctcagggttttgagtctcgtattcacatctttttactaagaagggctcctccagactcctggtgtatatttgttggaggccttaagctgttcgtggcagtacattgcggagcatagaacgaaaccgggtgtggaacactgagtcccaaggatagccatcttcagagatacggctcatgacccaggtacatggtaagcagagagcatcacacctgagcagcattcttactcagctcaacagcaatatctgagcccaagtttcccattccaatcaccaggatgcgttttccctcaaatccatctggatgcttgtattggcggctatggaaatattggcctttgaacctctccataccttcagggggaagaagagagaagtctgtgagctccagagcaactatgtcaagctaatttcaataaaactgcattgccagcttttcctttctggagttaataatttgtt

SEQ ID NO: 288311 - DNA, 383 bp, Homo sapiens
ttcttctttgcagcaaaacctcagggttttgagtctcgtattcacatctttttactaagaagggctcctccagactcctggtgtatatttgttggaggccttaaggtacatggtaagcagagagcatcacacctgagcagcattcttactcagctcaacagcaatatctgagcccaagtttcccattccaatcaccaggatgcgttttccctcaaatccatctggatgcttgtattggcggctatggaaatattggcctttgaacctctccataccttcagggggaagaagagagaagtctgtgagctccagagcaactatgtcaagctaatttcaataaaactgcattgccagcttttcctttctggagttaataatttgtt

SEQ ID NO: 288312 - DNA, 737 bp, Homo sapiens
ccaggaaaggcctgcgggagggggtcgtccagccccgcgtccccggcccggggcaggacgaagccccccttcccgtcgctcccgcttccagcaggacggccaggcccgcggccagcgcccacagtccccgcccgccgccgccttctcaccagcagtcccggttggggcacttgcccagcatgtgccggcggcagaagtgcagctggtcgcaggcctggcactcgccgcgctggtagcgggcgcagaggcgcacagaggacacggccaccaccctccaggcggaggtgccgccaccgcccaccgcgccggccgccgcctcggcctccgcgtccccgaggccctcctgcgtctccacctcctgcagcaggaaacgctcgggcccggcgcgctgcagcacgtcccggagcctggcctccgacagctccacgtggccgcgcaggtccttcaggaacatgcggccgccgtgggcgcacagcaccttgaaacggggtctcctcatgttgcccaggctggtctcgaactcctcaagcgatccacctgcctcagcctcccagagcactggaattacaggcgtgagccaccccgcggggcctgctgagctttattggaaagtggctagtccgaattgagatgtgatataagtgtgaaatacacacactagattttgaggactgagaatgagaaaaagaatgtaaaatatctcactaactttatatgaatcacatgttaaacataat

SEQ ID NO: 288313 - DNA, 181 bp, Homo sapiens
ctccctggcttggcagcagatgcatacctgggaaggatgctaggtcatccgggaactctacctccttcaaatccctaaggactgtgctcccaatccgcttacgctcaaggaagaactgcctggaagccctccctggtaccataccccagccgatgagtatgtacccccagaagtacttccg

SEQ ID NO: 288314 - DNA, 870 bp, Homo sapiens
aaaggcttgttgtcacgctcttgtatagccagaatgggaggtgagaatttggctttggagagtttgtctttgttcctgctgttttatgtccctcatgtttccttttataattgttttctcaggtttgcaccttctgctccatctcctcaccacatcagcccccggagagttccagctccttcttcaatactgcaaagaacacagcctccctatacccagcagccatcaggttcacacctgaagtcctatcagccagaaacaaactcttcttttcaaccaaatggtatccatgtccatggtaagcaagaagctggcagtcccttgagttttgaaaagtgacattgtgctgttgcttttcatcttagttacctgtcgtggatttcagatgctctgttctacaccaggcttaggctttcatgacttgcctctaaaatttcacacttgataggcatgaaatcctatggtattttcctgactttggcctgatgatggtatgatttatgacacatcgcactggtcagctcaagttgctggttttttcattggccagggctctaacaccagcaatagcatcctgtttctaaacaatagacagcccatggagaaagaaatgacaggagttcttgtgcccaagcatgcctctgctctgctaggtttttgctctcattctcataggtccacatcctctccgtccttcaaggcgcaggtggaatgacacctcctctctgaagcccttcctgatcccccagctgatgtcatctctccaggctctaaactctgattttatatcgcctgtctttctctggtagtatttatgcttcctctaccttgtgttttacttatctgtgaataaaacatactttcactatt

SEQ ID NO: 288315 - DNA, 1062 bp, Homo sapiens
ttgcggtccagcacagagctccatccagacctgctcacagattgcctcaccgtgcagtccctgcagccggccacttcccctagagatgctgctgctgaagggaccgtgggacgctcccctggacccgggcctgacctctattcagctcccattttctccagcaattattcaagccgaagtggaacagctgctggggccgtaccacccccacatcctgtcagtcacccttctccaggacataatgtacaggggagccctcacaacccctcctcccagttacctccactcacagctgtggacgcaggagctgagaggtttgcaccttctgctccatctcctcaccacatcagcccccggagagttccagctccttcttcaatactgcaaagaacacagcctccctatacccagcagccatcaggttcacacctgaagtcctatcagccagaaacaaactcttcttttcaaccaaatggtatccatgtccatggtaagcaagaagctggcagtcccttgagttttgaaaagtgacattgtgctgttgcttttcatcttagttacctgtcgtggatttcagatgctctgttctacaccaggcttaggctttcatgacttgcctctaaaatttcacacttgataggcatgaaatcctatggtattttcctgactttggcctgatgatggtatgatttatgacacatcgcactggtcagctcaagttgctggttttttcattggccagggctctaacaccagcaatagcatcctgtttctaaacaatagacagcccatggagaaagaaatgacaggagttcttgtgcccaagcatgcctctgctctgctaggtttttgctctcattctcataggtccacatcctctccgtccttcaaggcgcaggtggaatgacacctcctctctgaagcccttcctgatcccccagctgatgtcatctctccaggctctaaactctgattttatatcgcctgtctttctctggtagtatttatgcttcctctaccttgtgttttacttatctgtgaataaaacatactttcactatt

SEQ ID NO: 288316 - DNA, 2753 bp, Homo sapiens
gaaggtgggtgtggagagggagagagacagagaacggaacaactgaagatttttggttggtttatgtaaggaaaatggaggggaacaccgatacaggtttctctgtaaggtagagccttagcccagggtcattgtcgaatgtgttttacgttggcatacaacatttaagggatggatgccatttttattatttctcctttcaatgaacttttccaattgtctaaccagatgtggattacagtggtttcatataagaggatttctaaatcaggattacagagcaaaaccctccaggggtgcgtgacaggttgggagctgtggtgggtccaggcagaaatggcttccctgggaagttgcggaagaggcgtctctggagacgtgcttcgtgaggagagaagctgaagtgttgcaaacaacactggttggggtgggtgaaacctgggaagagggggtgaaacctgggaagaaatggggtgtggcactagagttcataaatagtagctgtggttagttttttttttttttttttttttttgagacggagtcattgcccaggctggagactccgtctcaaaaaaaaaaaaaaaaaaagctgccatccttttttctttcactttctagtttactctcatcagcaagccttatcaataatactaccttcgaatgatcttccaatgcaatcatttctgatcatttctacttctcacacatgcaggtccaaggcatcattgtcccttgcctaactacaatagtgtcctaattgcttatttttatttttgaggaataacatatatacagtaaactataaaaacgtgaagcatatagatatatgaattacgtatgtatcaagtgtcaagataaagaaaactcagcattcctaaagcttccccatgtcacttctcaaacatcctaaaaagaaaaagaaaaaaaaatcctttctttctacagaggtacgtactactctacctttaatcaccatagacaagtttttactgcttttgaactttagaattgaatcatacagtttgtactcatttctacctaatttcagtcaacatgttgagattggtccatactgtttcacatagcaagtgtgccttattttctattattatgcagtatccgattgtatgattatatcacgaattttagcattttcgaaattcagatcatttccaggctttggctattaagaagtagcaactaaccttattacacgttttttttcttccttgcttagtagaaaaacaggctctttaacatttttaataaatctctcacaaactgctgctcctagattacaaaaagtcaaagccaattccttgaatctgaacttcaagtcaccataatagaaaccgaagctgctgtaccttacattctgaaaggtacctcaacaaaagcacatcaaggactgtttaaaacttctagtatttaaaaagatccatctttccttccaatgcctatggatgataacaataaaaggagaaccttaagagatctgctattgagtttgagaaggccaaatttaatgattccaaactccagccttaaatatttctgtagagactccgagaaattacctctcccttgtctccactcccactggcttcctcaagcgcagatgcctgggaccctgtatgattagtcaaacagtcttaccagtaccatcattatgcttctctaaagggctactagtgaaagaagctgctttaatttattttagtttttgccaatcttcagtccttagaaaagtcttaattatttaaaaaaaaaaagggttggggaggtggttaactgttctaaggcattcaacaagaggaaacaggtaccttttatgaaaaggactttcaagttaagtccacagtttaactgaaataactttacaagaacgtctccacataaaactcttaacaccttacccctggcagccggatagatgcgatctacatacaacacgtctcttaaaatgctctcacagaaacggtaataagatactcttaacttccttaagtcaaatccacattcggccgcgctgccacctgcagaattagctgaaggggaaacaataaaggtcctgccggacagccatgagcagccctggtgctgctccccggatgcccccgagccgagaagcgaaggccacgctgggaatgtcgtcctcggaggcagagtacggggaagggatggttctgagcaggtgggcatcatggaggctccagattctcgtgtagcagtcctggcccactgccaccacgattccctcttcctcgtgcacatgcaggggcagataggcggactcattcacgtgaccttcgtactgccttacacatttagtggccctcagatcccacagcttgatctttccagtcatgtctgatgccatcaggcattgctcttcttggaggatttgcacagaggtcactgctgagtcatggaacaggcgagtggccctccaccccttgcctcgatttctacaacgcagatcaatggcaaagatctccccggagcgacagccattaaacagcaaaggagccgtactagcaaactgctgggccaagacatcactgctggtatcaaatgactgctggtgtcccgtcgccacgctggtcaacaggacctgctgagacaagcctgcactaaagcagtgatatgcccgggtgttgagggaccacgcacaggaccaggcctctgggatctggaaactgcagagcatgccaggctggttaactcttgtgtgaacacttaagaaccgc

SEQ ID NO: 288317 - DNA, 780 bp, Homo sapiens
gaaggtgggtgtggagagggagagagacagagaacggaacaactgaagatttttggttggtttatgtaaggaaaatggaggggaacaccgatacaggtttctctgtaaggtagagccttagcccagggtcattgtcgaatgtgttttacgttggcatacaacatttaagggatggatgccatttttattatttctcctttcaatgaacttttccaattgtctaaccagatgtggattacagtggtttcatataagaggatttctaaatcaggattacagagcaaaaccctccaggggtgcgtgacaggttgggagctgtggtgggtccaggcagaaatggcttccctgggaagttgcggaagaggcgtctctggagacgtgcttcgtgaggagagaagctgaagtgttgcaaacaacactggttgggttgtttcctgtcagttatggagtgatgaggtcacgcacttcattctggccagtcattaatatgatttggcattctctgcatgccaggcaagagtgactgctcttcaggccagatcttccttcgagatggatgttatctcctttttaggaaggaggaaacagagagacctcgtaacttggcatggccacacaatgggaataaactgagtgaccaagaggctgaatatcttctccaaagccaaagaaccaggcagtggcagagatccaaacccaagcgatttgggtgccagggctcaagcacttccccatgcagccactgcctcgagaaataaaaagactcaccagacacttcct

SEQ ID NO: 288318 - DNA, 480 bp, Homo sapiens
tcttaagaaactggtcctttattccagaaggttcattagctgctgcggcagttagatgcagtggtccaggaacgtgagtggggatgtgtgtggacaagaatactcactggagacccttttttcttgccctagcagttgtttcctgtcagttatggagtgatgaggtcacgcacttcattctggccagtcattaatatgatttggcattctctgcatgccaggcaagagtgactgctcttcaggccagatcttccttcgagatggatgttatctcctttttaggaaggaggaaacagagagacctcgtaacttggcatggccacacagtgagtcacacagttagtaaagatggaattcatacccaggtctgcctgactctgggattacgaagaattacatggttccacctcagtcccaaggtcatctttgctgtgccaaaagggaaaactggaaataggggtggtcagagcaggaggtgct

SEQ ID NO: 288319 - DNA, 1873 bp, Homo sapiens
aggatttccgcagggcgggagctgtttatctcccggaagaaaacggctcctgtcacagaagtctcgtgattgctctgggagctttgcttagacacttgaaactacaggagaaagaaggatctagcgaaatatggctacagagagccctgctacgcgtcgggtccaggtggcagaacatcctaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgataccactgaa

SEQ ID NO: 288320 - DNA, 342 bp, Homo sapiens
ttcagttacataaactgttcctggtcagaagctggaaatggggaatgtgaacatgagttgtcactaaatatgtaaaacagattttcttacatgtgcatgtagatgattaagtaacaagaatgtatcctctcctgccactgtaatttgggtgtgccaccatacattgcttatgaaatattgtccagtctatataaaagaagctagagagagaattctcaattattttcagaaagaaaacctaccagtttatgtaggaacttctcaaagtcctgtttcacttcatgaggtttcttggtagcctttgcttggagtctaatcatggaataaagaaaatcagtaacc

SEQ ID NO: 288321 - DNA, 1820 bp, Homo sapiens
aggctggtacggtccgcaatggcccgtactttgcttagacacttgaaactacaggagaaagaaggatctagcgaaatatggctacagagagccctgctacgcgtcgggtccaggtggcagaacatcctaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgataccactgaa

SEQ ID NO: 288322 - DNA, 3154 bp, Homo sapiens
aggatttccgcagggcgggagctgtttatctcccggaagaaaacggctcctgtcacagaagtctcgtgattgctctgggagctttgcttagacacttgaaactacaggagaaagaaggatctagcgaaatatggctacagagagccctgctacgcgtcgggtccaggtggcagaacatcctaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgataccactgaattgtatgcattattcttgaatagagttcatttctggtttctcttagtattcttcttcctcaaagttgtagttgtctgttgatgatggtgatgatgatgatgatgacgatagtgatgccacacattctctctcaatttcagcttcggaacgctatgaaaataatacatgattaaagtttcacagatcttcttggacattgtataattgaatttgaatgtgagatttctccagttatcaagagactaaggatttttttttttttttgacaaaaggaggatacaggaagaaaattcagactcatttgaatatttgtaaaccatgtaatatataaataaccactttcaattcttttggccctgagctatctccattacttaatagaaaaactcagatgaaaaacactttaagactcttctattcacattgaaataaagaattatctagatgataattcagataattcagtttgttcatagaattactttcttatcactctttttctactactttttctcaaatacctctctaatccaagaggcacttccaagaaattccacacattccttatatcccttttttgcttgtctagcaaagcttgtttgtatatatgcaccccattgtaaagcaggtatgcaggtatgtgggtgaaagtgactatgaaaagacttaatgaattctgggatttgtaatggtattgatgggtatctctgtatgtatatcaagagtgggcagaaatgtttggctggtgatggcaaatgactggctttctcttgtggatggactataggaagcactttctgaattatgcaatgatttggaccaaaaagtattttgctgaaatactcaggtaattgagatagcaatggttttatggcatgaattatccaaaaaaatatcagaattacttattattctgtgatttcattagctcattaatgtttaactcacagattgggcatcaccatctagaatttcagtttaagggaggcctgcgcaaagctagttttatttcttaaaggataacagtcatacatagaatactaggaaagccaatattctatttaaaaataaacttctgatgcattttcattcttagcagaaaggtaaatgcttgagaaagcttgagtcaaatttgttaaaagaattttgagttctataaatccaaaaatctgaaacctgaatttatttaaatttataatcctttattttttaataccgtgccattttccacaaaggatttgtggttggtatataattctttaaagatacctggatcagtgt

SEQ ID NO: 288323 - DNA, 2731 bp, Homo sapiens
aggatttccgcagggcgggagctgtttatctcccggaagaaaacggctcctgtcacagaagtctcgtgattgctctgggagctttgcttagacacttgaaactacaggagaaagaaggatctagcgaaatatggctacagagagccctgctacgcgtcgggtccaggtggcagaacatcctaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgataccactgaattgtatgcattattcttgaatagagttcatttctggtttctcttagtattcttcttcctcaaagttgtagttgtctgttgatgatggtgatgatgatgatgatgacgatagtgatgccacacattctctctcaatttcagcttcggaacgctatgaaaataatacatgattaaagtttcacagatcttcttggacattgtataattgaatttgaatgtgagatttctccagttatcaagagactaaggatttttttttttttttgacaaaaggaggatacaggaagaaaattcagactcatttgaatatttgtaaaccatgtaatatataaataaccactttcaattcttttggccctgagctatctccattacttaatagaaaaactcagatgaaaaacactttaagactcttctattcacattgaaataaagaattatctagatgataattcagataattcagtttgttcatagaattactttcttatcactctttttctactactttttctcaaatacctctctaatccaagaggcacttccaagaaattccacacattccttatatcccttttttgcttgtctagcaaagcttgtttgtatatatgcaccccattgtaaagcaggtatgcaggtatgtgggtgaaagtgactatgaaaagacttaatgaattctgggatttgtaatggtattgatgggtatctctgtatgtatatcaagagtgggcagaaatgtttggctggtgatggcaaatgactggctttctcttgtggatggactataggaagcactttctgaattatgcaatgatttggaccaaatgccatgagataccataatccagggaccgtcgag

SEQ ID NO: 288324 - DNA, 2123 bp, Homo sapiens
aggatttccgcagggcgggagctgtttatctcccggaagaaaacggctcctgtcacagaagtctcgtgattgctctgggagctttgcttagacacttgaaactacaggagaaagaaggatctagcgaaatatggctacagagagccctgctacgcgtcgggtccaggtggcagaacatcctaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgataccactgaattgtatgcattattcttgaatagagttcatttctggtttctcttagtattcttcttcctcaaagttgtagttgtctgttgatgatggtgatgatgatgatgatgacgatagtgatgccacacattctctctcaatttcagcttcggaacgcagtttatgtaggaacttctcaaagtcctgtttcacttcatgaggtttcttggtagcctttgcttggagtctaatcatggaataaagaaaatcagtaacc

SEQ ID NO: 288325 - DNA, 1943 bp, Homo sapiens
cgtttcctccgaagtggttggtgccttagcaactaaagctggcaactgggacatcgtccggtgctgcaggtctcagccgaagggcgtcggaaactgcgctcgcatcgagcagtttccagcctcctgggtaaaggagcagtctcctcccttgcttgggactctggacgcatctcattccggtgaaagtaagggacagcttaggaccagaagcctttcgcggagaaaaggctgacatgcccgtcctatatgacaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgataccactgaa

SEQ ID NO: 288326 - DNA, 2065 bp, Homo sapiens
cgtttcctccgaagtggttggtgccttagcaactaaagctggcaactgggacatcgtccggtgctgcaggtctcagccgaagggcgtcggaaactgcgctcgcatcgagcagtttccagcctcctgggtaaaggagcagtctcctcccttgcttgggactctggacgcatctcattccggtgaaagtaagggacagcttaggaccagaagcctttcgcggagaaaaggctgacatgcccgtcctatatgacagatggagtcttgctttgttgcccagtctagagtgcagtggcatgatctcggctcactacaacctccgcctcctgggttcaagtgattctcctgcctcagcctccctagaagctggaattacaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgataccactgaa

SEQ ID NO: 288327 - DNA, 2018 bp, Homo sapiens
aggatttccgcagggcgggagctgtttatctcccggaagaaaacggctcctgtcacagaagtctcgtgattgctctgggagctttgcttagacacttgaaactacaggagaaagaaggatctagcgaaatatggctacagagagccctgctacgcgtcgggtccaggtggcagaacatcctaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccgtcttccgggctgcagggctccctcaggcagaggctatgacctgcagataggccacaccattcttggactggtcctgtagagcagggttccccaatccctgttactgcttcatggcctgttcagaagtgggccacacagcaggagggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgataccactgaa

SEQ ID NO: 288328 - DNA, 1438 bp, Homo sapiens
acttagggctaggtacgaggctgggtgttgaatcggccgaggaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgataccactgaa

SEQ ID NO: 288329 - DNA, 1678 bp, Homo sapiens
aggatttccgcagggcgggagctgtttatctcccggaagaaaacggctcctgtcacagaagtctcgtgattgctctgggagctttgcttagacacttgaaactacaggagaaagaaggatctagcgaaatatggctacagagagccctgctacgcgtcgggtccaggtggcagaacatcctaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggtgctttggaaataccagccagctcatgcatcttaagataatataaaatcaatggactctgacctccaaaattgaagagaacacgattaaactctggaccagtactactatagtgcgactgtaagaggaagaaaataatcaagacaacgattacttttgtgtttctaaaaaactgtgaataaaatataacttcatatttagcataaagttaccatttgatatattaaaataaaggaaattctacaaagcatcttcttaattagaggaatttaccaaagtatgagtctataagtacgtgcagtaaggctcttctactcttttgagttatcatcagacttgcatataggcaatagacattattcagtcttaagaacagaaa

SEQ ID NO: 288330 - DNA, 1955 bp, Homo sapiens
aggatttccgcagggcgggagctgtttatctcccggaagaaaacggctcctgtcacagaagtctcgtgattgctctgggagctttgcttagacacttgaaactacaggagaaagaaggatctagcgaaatatggctacagagagccctgctacgcgtcgggtccaggtggcagaacatcctaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatggcctgggaattttcataaattttccaaaattttcccagacccaccacaccagctcagcaactgttcagcatgggtgaaaatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgataccactgaa

SEQ ID NO: 288331 - DNA, 2041 bp, Homo sapiens
cgtttcctccgaagtggttggtgccttagcaactaaagctggcaactgggacatcgtccggtgctgcaggtctcagccgaagggcgtcggaaactgcgctcgcatcgagcagtttccagcctcctgggtaaaggagcagtctcctcccttgcttgggactctggacgcatctcattccggtgaaagtaagggacagcttaggaccagaagcctttcgcggagaaaaggctgacatgcccgtcctatatgacagtctagagtgcagtggcatgatctcggctcactacaacctccgcctcctgggttcaagtgattctcctgcctcagcctccctagaagctggaattacaggttactgaagctaaaggagatgtttaactccaagtttggatctattcccaagttttatgttcgagcaccaggaagagtcaacataataggagagcatatagattattgtggatattctgttcttcctatggctgtagaacaagatgtgctaatagctgtagaacctgtgaaaacgtacgctctccaactggccaatacaaatcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgataccactgaa

SEQ ID NO: 288332 - DNA, 1531 bp, Homo sapiens
gctcggttccctgtgctacctccacttacaggccaatacgatgcccttgtatccggacttcagtactagtgctaataacatccagattgataaaaccaagcctttgtggcacaactatttcttatgtggacttaaaggaattcaggaacactttggtcttagtaacctgactggaatgaactgcctggtagatggaaatatcccaccaagttctggcctctccagctccagtgctttggtctgttgtgctggcttggtgacgctcacagtgctgggaaggaatctatccaaggtggaacttgcagaaatctgtgccaagagtgagcgttacattggcactgaaggaggaggcatggaccagtctatatcatttcttgcagaagaaggaactgccaagttgatagaatttagtcctctgagggcaaccgatgtaaaactcccaagtggagcagtgtttgtgattgccaacagttgtgtggagatgaataaggcagcaacttcccatttcaatatcagggtgatggagtgtcggctggctgcgaagctcctggctaaatacaaaagcttgcaatgggacaaagtactgaggctggaggaggtgcaggctaaactagggattagtctagaagaaatgctgttggtcacagaagatgcccttcatcctgaaccctataaccctgaggagatctgcaggtgtctgggaattagcctggaggaactccgaacccaaatcctgagtccaaacactcaagatgtgctcatcttcaaactctatcagcgggcaaagcatgtgtacagcgaggctgcgcgagtgctccagtttaagaagatatgtgaagaagcacctgaaaacatggtccagctgctgggagagttgatgaaccagagccacatgagctgccgggacatgtatgagtgcagctgccccgagctggatcagctggtggacatctgtcggaagtttggggctcaagggtcacgacttactggagcaggatggggaggctgcacagtatcaatggtacctgcggacaagctgcccagctttctagcaaatgtgcacaaagcttattaccagaggagtgatggaagcttagcaccggagaagcaaagtttgtttgctaccaaacctggaggtggggctttggttttgcttgaggcctgaaaaaatgtaaaaagtctgagagaaactacttagggcacttaggaattggcaggactttctgtgccacagtaaattaatcttccttctgttttgtattatgatgaacggttgctattatatcaagatatattttcaaagaaatggttgaaagctctctatgcttcataatgattctttttccatcttaaaatatggttttactattaagagccaagatcatgcttggacagatcttttaagaataacttactgagatttattgatttgaagattttaaagatgaatggtaaaacacactcttaatactgattacatggattggacttgaattaaatatattgttacaattaaactgataccactgaa

SEQ ID NO: 288333 - DNA, 1910 bp, Homo sapiens
actccaggtcccctatcctgtcctctgcaacccaaacgtccaggaggatcatgacctgcggatcaggatttggtgggcgcgccttcagctgcatctcggcctgcgggccgcgccccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaagtcagacctggaggccaacgtggaggccctgatccaggagatcgacttcctgaggcggctgtatgaggaggagatccgcattctccagtcgcacatctcagacacctccgtggttgtcaagctggacaacagccgggacctgaacatggactgcatcattgccgagattaaggcacagtatgacgacattgtcacccgcagccgggccgaggccgagtcctggtaccgcagcaagtgtgaggagatgaaggccacggtgatcaggcacggggagaccctgcgccgcaccaaggaggagatcaacgagctgaaccgcatgatccagaggctgacggccgaggtggagaatgccaagtgccagaactccaagctggaggccgcggtggcccagtctgagcagcagggtgaggcggccctcagtgatgcccgctgcaagctggccgagctggagggcgccctgcagaaggccaagcaggacatggcctgcctgatcagggagtaccaggaggtgatgaactccaagctgggcctggacatcgagatcgccacctacaggcgcctgctggagggcgaggagcagaggctatgtgaaggcattggggctgtgaatgtctgtgtcagcagctcccggggcggggtcgtgtgcggggacctctgcgtgtcaggctcccggccagtgactggcagtgtctgcagcgctccgtgcaacgggaacgtggcggtgagcaccggcctgtgtgcgccctgcggccaattgaacaccacctgcggagggggttcctgcggcgtgggctcctgtggtatcagctccctgggtgtggggtcttgcggcagcagctgccggaaatgttaggcaccccaactcaagtcccaggccccaggcatctttcctgccctgccttgcttggcccatccagtccaggcgcctggagcaagtgctcagctacttctcctgcactttgaaagacccctcccactcctggcctcacatttctctgtgtgatcccccacttctgggctctgccaccccacagtgggaaaggccaccctagaaagaagtccgctggcacccataggaaggggcctcaggagcaggaagggccaggaccagaaccttgcccacggcaactgccttcctgcctctccccttcctcctctgctcttgatctgtgtttcaataaattaatgtagccaa

SEQ ID NO: 288334 - DNA, 645 bp, Homo sapiens
  misc_feature (21)..(21): n is a, c, g, or t
gcttctgcagtcacctaagcntcccctttcagaggctattaaggcattggggctgtgaatgtctgtgtcagcagctcccggggcggggtcgtgtgcggggacctctgcgtgtcaggctcccggccagtgactggcagtgtctgcagcgctccgtgcaacgggaacgtggcggtgagcaccggcctgtgtgcgccctgcggccaattgaacaccacctgcggagggggttcctgcggcgtgggctcctgtggtatcagctccctgggtgtggggtcttgcggcagcagctgccggaaatgttaggcaccccaactcaagtcccaggccccaggcatctttcctgccctgccttgcttggcccatccagtccaggcgcctggagcaagtgctcagctacttctcctgcactttgaaagacccctcccactcctggcctcacatttctctgtgtgatcccccacttctgggctctgccaccccacagtgggaaaggccaccctagaaagaagtccgctggcacccataggaaggggcctcaggagcaggaagggccaggaccagaaccttgcccacggcaactgccttcctgcctctccccttcctcctctgctcttgatctgtgtttcaataaattaatgtagccaa

SEQ ID NO: 288335 - DNA, 1777 bp, Homo sapiens
  misc_feature (1770)..(1770): n is a, c, g, or t
actccaggtcccctatcctgtcctctgcaacccaaacgtccaggaggatcatgacctgcggatcaggatttggtgggcgcgccttcagctgcatctcggcctgcgggccgcgccccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaagtcagacctggaggccaacgtggaggccctgatccaggagatcgacttcctgaggcggctgtatgaggaggagatccgcattctccagtcgcacatctcagacacctccgtggttgtcaagctggacaacagccgggacctgaacatggactgcatcattgccgagattaaggcacagtatgacgacattgtcacccgcagccgggccgaggccgagtcctggtaccgcagcaagtgtgaggagatgaaggccacggtgatcaggcacggggagaccctgcgccgcaccaaggaggagatcaacgagctgaaccgcatgatccagaggctgacggccgaggtggagaatgccaagtgccagaactccaagctggaggccgcggtggcccagtctgagcagcagggtgaggcggccctcagtgatgcccgctgcaagctggccgagctggagggcgccctgcagaaggccaagcaggacatggcctgcctgatcagggagtaccaggaggtgatgaactccaagctgggcctggacatcgagatcgccacctacaggcgcctgctggagggcgaggagcagaggctatgtgaaggcattggggctgtgaatgtctgtgtcagcagctcccggggcggggtcgtgtgcggggacctctgcgtgtcaggctcccggccagtgactggcagtgtctgcagcgctccgtgcaacgggaacgtggcggtgagcaccggcctgtgtgcgccctgcggccaattgaacaccacctgcggagggggttcctgcggcgtgggctcctgtggtatcagctccctgggtgtggggtcttgcggcagcagctgccggaaatgttaggcaccccaactcaagtcccaggccccaggcatctttcctgccctgccttgcttggcccatccagtccaggcgcctggagcaagtgctcagctacttctcctgcactttgaaagacccctcccactcctggcctcacatttctctgtgtgatcccccacttctgggctctgccaccccgtcgggagcgggatacctcaaggantcaacaa

SEQ ID NO: 288336 - DNA, 1506 bp, Homo sapiens
aggcgcagccgcgacctgggtgagtggctttgctgcgagcccacgcgccctttgcccagaggctcccagacccgcccagcgggaggaggggacggaccccactacttacagacattcaccgagccgacgccctcgcacagcctgcagggagagaaggcgagagggccaagggcctgactgtccacaaaaaaaaaggagcttcgagtgagaccaactgaccaactaggggaaagaaaccaagggcaaagaatgagctcacattctgggagtgttgtccttctgggagcaggagctgtatagctgccctccagctgtatcgctggcctccagccataggaaggctgagtgaccaatgggtcttctccactccccccacctctgaagcaagcaaacaagcaaaaatcctgaaagcaaggcataactgccccaagggataagtccttgctctctgcctaactcattcccacctgccacaatggaataccactttgggatgctcattggcactataatagaaaagcatgagttgatagtgtcatctatctgaagctgtccttatgggatacatctgaactcccaggtctagatggggccagggccagactaggaaaaagagaaggaatcctgagaagcacatgcagctacagctggaagggaagaagcactacccagaactccaagctggaggccgcggtggcccagtctgagcagcagggtgaggcggccctcagtgatgcccgctgcaagctggccgagctggagggcgccctgcagaaggccaagcaggacatggcctgcctgatcagggagtaccaggaggtgatgaactccaagctgggcctggacatcgagatcgccacctacaggcgcctgctggagggcgaggagcagaggctatgtgaaggcattggggctgtgaatgtctgtgtcagcagctcccggggcggggtcgtgtgcggggacctctgcgtgtcaggctcccggccagtgactggcagtgtctgcagcgctccgtgcaacgggaacgtggcggtgagcaccggcctgtgtgcgccctgcggccaattgaacaccacctgcggagggggttcctgcggcgtgggctcctgtggtatcagctccctgggtgtggggtcttgcggcagcagctgccggaaatgttaggcaccccaactcaagtcccaggccccaggcatctttcctgccctgccttgcttggcccatccagtccaggcgcctggagcaagtgctcagctacttctcctgcactttgaaagacccctcccactcctggcctcacatttctctgtgtgatcccccacttctgggctctgccaccccacagtgggaaaggccaccctagaaagaagtccgctggcacccataggaaggggcctcaggagcaggaagggccaggaccagaaccttgcccacggcaactgccttcctgcctctccccttcctcctctgctcttgatctgtgtttcaataaattaatgtagccaa

SEQ ID NO: 288337 - DNA, 1002 bp, Homo sapiens
actccaggtcccctatcctgtcctctgcaacccaaacgtccaggaggatcatgacctgcggatcaggatttggtgggcgcgccttcagctgcatctcggcctgcgggccgcgccccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaagtcagacctggaggccaacgtggaggccctgatccaggagatcgacttcctgaggcggctgtatgaggaggagatccgcattctccagtcgcacatctcagacacctccgtggttgtcaagctggacaacagccgggacctgaacatggactgcatcattgccgagattaaggcacagtatgacgacattgtcacccgcagccgggccgagccgtcagcctctggatcatgcggttcagctcgttgatctcctccttggtgcggcgcagggtctccccgtgcctgat

SEQ ID NO: 288338 - DNA, 1961 bp, Homo sapiens
actccaggtcccctatcctgtcctctgcaacccaaacgtccaggaggatcatgacctgcggatcaggatttggtgggcgcgccttcagctgcatctcggcctgcgggccgcgccccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaagtcagacctggaggccaacgtggaggccctgatccaggagatcgacttcctgaggcggctgtatgaggaggagatccgcattctccagtcgcacatctcagacacctccgtggttgtcaagctggacaacagccgggacctgaacatggactgcatcattgccgagattaaggcacagtatgacgacattgtcacccgcagccgggccgaggccgagtcctggtaccgcagcaagtgtgaggagatgaaggccacggtgatcaggcacggggagaccctgcgccgcaccaaggaggagatcaacgagctgaaccgcatgatccagaggctgacggccgaggtggagaatgccaagtgccagaactccaagctggaggccgcggtggcccagtctgagcagcagggtgaggcggccctcagtgatgcccgctgcaagctggccgagctggagggcgccctgcagaaggccaagcaggacatggcctgcctgatcagggagtaccaggaggtgatgaactccaagctgggcctggacatcgagatcgccacctacaggcgcctgctggagggcgaggagcagaggctatgtgaaggcattggggctgtgaatgtctgtgtcagcagctcccggggcggggtcgtgtgcggggacctctgcgtgtcaggctcccggccagtgactggcagtgtctgcagcgctccgtgcaacgggaacgtggcggtgagcaccggcctgtgtgcgccctgcggccaattgaacaccacctgcggagggggttcctgcggcgtgggctcctgtggtatcagctccctgggtgtggggtcttgcggcagcagctgccggaaatgttaggcaccccaactcaagtcccaggccccaggcatctttcctgccctgccttgcttggcccatccagtccaggcgcctggagcaagtgctcagctacttctcctgcactttgaaagacccctcccactcctggcctcacatttctctgtgtgatcccccacttctgggctctgccaccccacagtgggaaaggccaccctagaaagaagtccgctggcacccataggaaggggcctcaggagcaggaagggccaggaccagaaccttgcccacggcaactgccttcctgcctctccccttcctcctacctttggtctctgggtgtatggggacttttattttttttttatttttttttttttttatttttttttttttttttttttttttattaat

SEQ ID NO: 288339 - DNA, 1113 bp, Homo sapiens
gtgtggtgaaccttctgacatacatcgcgcgtctccctctgcgccgcgcatctacgttggacgtttccctgcatcattgccgagattaaggcacagtatgacgacattgtcacccgcagccgggccgaggccgagtcctggtaccgcagcaagtgtgaggagatgaaggccacggtgatcaggcacggggagaccctgcgccgcaccaaggaggagatcaacgagctgaaccgcatgatccagaggctgacggccgaggtggagaatgccaagtgccagaactccaagctggaggccgcggtggcccagtctgagcagcagggtgaggcggccctcagtgatgcccgctgcaagctggccgagctggagggcgccctgcagaaggccaagcaggacatggcctgcctgatcagggagtaccaggaggtgatgaactccaagctgggcctggacatcgagatcgccacctacaggcgcctgctggagggcgaggagcagaggctatgtgaaggcattggggctgtgaatgtctgtgtcagcagctcccggggcggggtcgtgtgcggggacctctgcgtgtcaggctcccggccagtgactggcagtgtctgcagcgctccgtgcaacgggaacgtggcggtgagcaccggcctgtgtgcgccctgcggccaattgaacaccacctgcggagggggttcctgcggcgtgggctcctgtggtatcagctccctgggtgtggggtcttgcggcagcagctgccggaaatgttaggcaccccaactcaagtcccaggccccaggcatctttcctgccctgccttgcttggcccatccagtccaggcgcctggagcaagtgctcagctacttctcctgcactttgaaagacccctcccactcctggcctcacatttctctgtgtgatcccccacttctgggctctgccaccccacagtgggaaaggccaccctagaaagaagtccgctggcacccataggaaggggcctcaggagcaggaagggccaggaccagaaccttgcccacggcaactgccttcctgcctctccccttcctcctctgctcttgatctgtgtttcaataaattaatgtagccaa

SEQ ID NO: 288340 - DNA, 641 bp, Homo sapiens
  misc_feature (43)..(43): n is a, c, g, or t
gtagactcaagagcatccccggttcgaggctatgtgaaggcanttggggctttaatgtctgtgtcagcagctcccggggcggggtcgtgtgcggggacctctgcgtgtcaggctcccggccagtgactggcagtgtctgcagcgctccgtgcaacgggaacgtggcggtgagcaccggcctgtgtgcgccctgcggccaattgaacaccacctgcggagggggttcctgcggcgtgggctcctgtggtatcagctccctgggtgtggggtcttgcggcagcagctgccggaaatgttaggcaccccaactcaagtcccaggccccaggcatctttcctgccctgccttgcttggcccatccagtccaggcgcctggagcaagtgctcagctacttctcctgcactttgaaagacccctcccactcctggcctcacatttctctgtgtgatcccccacttctgggctctgccaccccacagtgggaaaggccaccctagaaagaagtccgctggcacccataggaaggggcctcaggagcaggaagggccaggaccagaaccttgcccacggcaactgccttcctgcctctccccttcctcctctgctcttgatctgtgtttcaataaattaatgtagccaa

SEQ ID NO: 288341 - DNA, 2314 bp, Homo sapiens
tcgacccacgcgtccgcggacgcgtgggtcgacccacgcgtcgcgtgtagaatgtggggcgcctgtaaagttaaggttcacgattccttggccaccatttccatcactctgagacggtacctgagattgggggcgaccatggcaaaaagcaagttcgagtacgtgagggacttcgaggctgacgacacctgcctggcacactgctgggtggtagtgcggctggacggccggaatttccatcggtttgctgagaagcacaactttgcaaaacccaatgacagccgtgctctccagctgatgaccaaatgtgcgcagactgtgatggaagaactagaggatattgtgatcgcgtatggacagagtgatgagtacagctttgtgttcaagcggaaaaccaattggtttaaaagaagagccagtaagttcatgactcacgtggcctcccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagctgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgcgaatgacacaactcaagttgggaggggaacagggaaggaagggatggatgggggtggtgtatcttactctgtttaagcagaacaccttgtttgcggtgttggaacatggttcctttggcagaagtgctttttttttaatcgcagtactatttttataaagcaagaactattccatgccttggagaatgaatcatttttagattgtgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacatttaccccatgtactcaagacatttcagttttaaaagtcactttcctattagacttcttgaaaaacattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggaacagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagctacttgggaggttgaggcaggagaatcatttgaactcaggaggcggaagttgcggtgagccaagattgtgccattgcactccagcctgggcaacgagcgaaactacatctcaaaaa

SEQ ID NO: 288342 - DNA, 2257 bp, Homo sapiens
tcgacccacgcgtccgcggacgcgtgggtcgacccacgcgtcgcgtgtagaatgtggggcgcctgtaaagttaaggttcacgattccttggccaccatttccatcactctgagacggtacctgagattgggggcgaccatggcaaaaagcaagttcgagtacgtgagggacttcgaggctgacgacacctgcctggcacactgctgggtggtagtgcggctggacggccggaatttccatcggtttgctgagaagcacaactttgcaaaacccaatgacagccgtgctctccagctgatgaccaaatgtgcgcagactgtgatggaagaactagaggatattgtgatcgcgtatggacagagtgatgagtacagctttgtgttcaagcggaaaaccaattggtttaaaagaagagccagtaagttcatgactcacgtggcctcccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagctgccgatgtataggaaagggactgtgttgatatggcagaaggtggatgaagtgatgacaaaagaaattaagctgccaacagaaatggaaggaaaaaagatggcagtgacccggaccaggacaaagccacctcccacctcccagggctccttgccttaggtggctgtagcatccctaccacccaggacactggtgcgaatgacacaactcaagttgggaggggaacagggaaggaagggatggatgggggtggtgtatcttactctgtttaagcagaacaccttgtttgcggtgttggaacatggttcctttggcagaagtgctttttttttaatcgcagtactatttttataaagcaagaactattccatgccttggagaatgaatcatttttagattgtgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaacattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggaacagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagctacttgggaggttgaggcaggagaatcatttgaactcaggaggcggaagttgcggtgagccaagattgtgccattgcactccagcctgggcaacgagcgaaactacatctcaaaaa

SEQ ID NO: 288343 - DNA, 2333 bp, Homo sapiens
tcgacccacgcgtccgcggacgcgtgggtcgacccacgcgtcgcgtgtagaatgtggggcgcctgtaaagttaaggttcacgattccttggccaccatttccatcactctgagacggtacctgagattgggggcgaccatggcaaaaagcaagttcgagtacgtgagggacttcgaggctgacgacacctgcctggcacactgctgggtggtagtgcggctggacggccggaatttccatcggtttgctgagaagcacaactttgcaaaacccaatgacagccgtgctctccagctgatgaccaaatgtgcgcagactgtgatggaagaactagaggatattgtgatcgcgtatggacagagtgatgagtacagctttgtgttcaagcggaaaaccaattggtttaaaagaagagccagtatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagctgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgcgaatgacacaactcaagttgggaggggaacagggaaggaagggatggatgggggtggtgtatcttactctgtttaagcagaacaccttgtttgcggtgttggaacatggttcctttggcagaagtgctttttttttaatcgcagtactatttttataaagcaagaactattccatgccttggagaatgaatcatttttagattgtgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaacattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggaacagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagctacttgggaggttgaggcaggagaatcatttgaactcaggaggcggaagttgcggtgagccaagattgtgccattgcactccagcctgggcaacgagcgaaactacatctcaaaaa

SEQ ID NO: 288344 - DNA, 400 bp, Homo sapiens
ctgtaaagttaaggttcacgattccttggccaccatttccatcactctgagacggtacctgagattgggggcgaccatggcaaaaagcaagttcgagtacgtgagggacttcgaggctgacgacacctgcctggcacactgctgggtggtagtgcggctggacggccggaatttccatcggtgagcgagctcgactcggggcgtcgcgatgcgccagcgcttccggggaatccagcttcttcccttgcaagtcctcccgcccgctccagtcacggttaccagggtaacgcggtagccaatgagtgcgcagcatggagcattgccccgccctgcgtgttggctaggacagtgcctgaacgctggctgttagcgtaattgaatgggcgatgtgctcccgtga

SEQ ID NO: 288345 - DNA, 1229 bp, Homo sapiens
tcgacccacgcgtccgcggacgcgtgggtcgacccacgcgtcgcgtgtagaatgtggggcgcctgtaaagttaaggttcacgattccttggccaccatttccatcactctgagacggtacctgagattgggggcgaccatggcaaaaagcaagttcgagtacgtgagggacttcgaggctgacgacacctgcctggcacactgctgggtggtagtgcggctggacggccggaatttccatcggtttgctgagaagcacaactttgcaaaacccaatgacagccgtgctctccagctgatgaccaaatgtgcgcagactgtgatggaagaactagaggatattgtgatcgcgtatggacagagtgatgagtacagctttgtgttcaagcggaaaaccaattggtttaaaagaagagccagtaagttcatgactcacgtggcctcccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagctgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgcgaatgacacaactcaagttgggaggggaacagggaaggaagggatggatgggggtggtgtatcttactctgtttaagcagaacaccttgtttgcggtgttggaacatggttcctttggcagaagtgctttttttttaatcgcagtactatttttataaagcaagaactattcc

SEQ ID NO: 288346 - DNA, 2324 bp, Homo sapiens
tcgacccacgcgtccgcggacgcgtgggtcgacccacgcgtcgcgtgtagaatgtggggcgcctgtaaagttaaggttcacgattccttggccaccatttccatcactctgagacggtacctgagattgggggcgaccatggcaaaaagcaagttcgagtacgtgagggacttcgaggctgacgacacctgcctggcacactgctgggtggtagtgcggctggacggccggaatttccatcggtttgctgagaagcacaactttgcaaaacccaatgacagccgtgctctccagctgatgaccaaatgtgcgcagactgtgatggaagaactagaggatattgtgatcgcgtatggacagagtgatgagtacagctttgtgttcaagcggaaaaccaattggtttaaaagaagagccagtaagttcatgactcacgtggcctcccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagctgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccacccaggacactggtgcgaatgacacaactcaagttgggaggggaacagggaaggaagggatggatgggggtggtgtatcttactctgtttaagcagaacaccttgtttgcggtgttggaacatggttcctttggcagaagtgctttttttttaatcgcagtactatttttataaagcaagaactattccatgccttggagaatgaatcatttttagattgtgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaacattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggaacagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagctacttgggaggttgaggcaggagaatcatttgaactcaggaggcggaagttgcggtgagccaagattgtgccattgcactccagcctgggcaacgagcgaaactacatctcaaaaa

SEQ ID NO: 288347 - DNA, 2278 bp, Homo sapiens
tcgacccacgcgtccgcggacgcgtgggtcgacccacgcgtcgcgtgtagaatgtggggcgcctgtaaagttaaggttcacgattccttggccaccatttccatcactctgagacggtacctgagattgggggcgaccatggcaaaaagcaagttcgagtacgtgagggacttcgaggctgacgacacctgcctggcacactgctgggtggtagtgcggctggacggccggaatttccatcggtttgctgagaagcacaactttgcaaaacccaatgacagccgtgctctccagctgatgaccaaatgtgcgcagactgtgatggaagaactagaggatattgtgatcgcgtatggacagagtgatgagtacagctttgtgttcaagcggaaaaccaattggtttaaaagaagagccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagctgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgcgaatgacacaactcaagttgggaggggaacagggaaggaagggatggatgggggtggtgtatcttactctgtttaagcagaacaccttgtttgcggtgttggaacatggttcctttggcagaagtgctttttttttaatcgcagtactatttttataaagcaagaactattccatgccttggagaatgaatcatttttagattgtgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaacattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggaacagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagctacttgggaggttgaggcaggagaatcatttgaactcaggaggcggaagttgcggtgagccaagattgtgccattgcactccagcctgggcaacgagcgaaactacatctcaaaaa

SEQ ID NO: 288348 - DNA, 1052 bp, Homo sapiens
ggtgtccacctcagtcaggccacggtggaagacgcgtgccgcggcgcctggttgcctgcagcggcccggacccgagaggaagctgaaccatctatctccagaaatgtcttcagaaagtaaagagcaacataacgtttcacccagagactcagctgaaggaaatgacagttatccatctgggatccatctggaacttcaaagggaatcaagtactgacttcaagcaatttgagaccaatgatcaatgcagaccttatcataggatccttattgagcgtcaagagaaatcagatacaaacttcaaggagtttgttattaaaaagctgcagaagaattgccagtgcagtccagccaaagccaaaaatatgattttaggtttccttcctgttttgcagtggctcccaaaatacgacctaaagaaaaacattttaggggatgtgatgtcaggcttgattgtgggcatattattggtgccccagtccattgcttattccctgctggctggccaagaacctgtctatggtctgtacacatctttttttgccagcatcatttattttctcttgggtacctcccgtcacatctctgtgggcatttttggagtactgtgccttatgattggtgagacagttgaccgagaactacagaaagctggctatgacaatgcccatagtgctccttccttaggaatggtttcaaatgggagcacattattaaatcatacatcagacaggatatgtgacaaaagttgctatgcaattatggttggcagcactgtaacctttatagctggagtttatcagtgattgttttgttaatgtggaagcaacattttctatgattaatctgctgttacctgttttgactgagctactacaaaaagaaaaatcactgaattgctatgggtttctgaaatatccaaaaaattaacctgaagcagggggaaaaatgacatcacaccattagcaggtattgtgtgaaacttctaaaaatgaaactgacatttatctgacttattaggaataaatactctctaatgaactctctaatgat

SEQ ID NO: 288349 - DNA, 3552 bp, Homo sapiens
ggtgtccacctcagtcaggccacggtggaagacgcgtgccgcggcgcctggttgcctgcagcggcccggacccgagaggaagctgaaccatctatctccagaaatgtcttcagaaagtaaagagcaacataacgtttcacccagagactcagctgaaggaaatgacagttatccatctgggatccatctggaacttcaaagggaatcaagtactgacttcaagcaatttgagaccaatgatcaatgcagaccttatcataggatccttattgagcgtcaagagaaatcagatacaaacttcaaggagtttgttattaaaaagctgcagaagaattgccagtgcagtccagccaaagccaaaaatatgattttaggtttccttcctgttttgcagtggctcccaaaatacgacctaaagaaaaacattttaggggatgtgatgtcaggcttgattgtgggcatattattggtgccccagtccattgcttattccctgctggctggccaagaacctgtctatggtctgtacacatctttttttgccagcatcatttattttctcttgggtacctcccgtcacatctctgtgggcatttttggagtactgtgccttatgattggtgagacagttgaccgagaactacagaaagctggctatgacaatgcccatagtgctccttccttaggaatggtttcaaatgggagcacattattaaatcatacatcagacaggatatgtgacaaaagttgctatgcaattatggttggcagcactgtaacctttatagctggagtttatcaggtagcgatgggcttctttcaagtgggttttgtttctgtctacctctcagatgccttgctgagtggatttgtcactggtgcctccttcactattcttacatctcaggccaagtatcttcttgggctcaaccttcctcggactaatggtgtgggctcactcatcactacctggatacatgtcttcagaaacatccataagaccaatctctgtgatcttatcaccagccttttgtgccttttggttcttttgccaaccaaagaactcaatgaacacttcaaatccaagcttaaggcaccgattcctattgaacttgttgttgttgtagcagccacattagcctctcattttggaaaactacatgaaaattataattctagtattgctggacatattcccactgggtttatgccacccaaagtaccagaatggaacctaattcctagtgtggctgtagatgcaatagctatttccatcattggttttgctatcactgtatcactttctgagatgtttgccaagaaacatggttacacagtcaaagcaaaccaggaaatgtatgccattggcttttgtaatatcatcccttccttcttccactgttttactactagtgcagctcttgcaaagacattggttaaagaatcaacaggctgccatactcagctttctggtgtggtaacagccctggttcttttgttggtcctcctagtaatagctcctttgttctattcccttcaaaaaagtgtccttggtgtgatcacaattgtaaatctacggggagcccttcgtaaatttagggatcttcccaaaatgtggagtattagtagaatggatacagttatctggtttgttactatgctgtcctctgcactgctaagtactgaaataggcctacttgttggggtttgtttttctatattttgtgtcatcctccgcactcagaagccaaagagttcactgcttggcttggtggaagagtctgaggtctttgaatctgtgtctgcttacaagaaccttcagactaagccaggcatcaagattttccgctttgtagcccctctctactacataaacaaagaatgctttaaatctgctttatacaaacaaactgtcaacccaatcttaataaaggtggcttggaagaaggcagcaaagagaaagatcaaagaaaaagtagtgactcttggtggaatccaggatgaaatgtcagtgcaactttcccatgatcccttggagctgcatactatagtgattgactgcagtgcaattcaatttttagatacagcagggatccacacactgaaagaagttcgcagagattatgaagccattggaatccaggttctgctggctcagtgcaatcccactgtgagggattccctaaccaacggagaatattgcaaaaaggaagaagaaaaccttctcttctatagtgtgtatgaagcgatggcttttgcagaagtatctaaaaatcagaaaggagtatgtgttcccaatggtctgagtcttagtagtgattaattgagaaggtagatagaagaatgtctagccaataggttaaaatttcaagtgtccaacatttcccagttccacagtgggaaattttgcacacttgaaattttaaccaagtggctagatattattcctcctttgaagctaatggcatttgtatatacacactgcagcagagcttgtagctggacagagtcaaaaagaagaaaatacggtttcaggctttcttgcagatatgaagtattcttggaatgcaataagtatgtattgaactgtactgtaaagtagctccaaaacttaattactctcctgttttaggggttatacatttggactgtgcattctccaagagatgaagcggtgaagttgggatttacattggaagtgctgtagacttctttatgtggctcagtggagagagggaaagaatgttgcacctgctctagtaccataggtcaagaggcttctggatcacaaagtcataactagacaggtttgttcttgtagttttctatccccagtctttgctccccagatggcagtagtttttagtaggaaagtgccattcctgtccttaaggcacagtctcatcagaagtctaatacctgggcaggtttataacatcctgagagccagcctgacattagacagaataccctttgtaatacattggaaatttttactcatgcctttttgtttaggataaataggtaagcacaaagagctcttcaaaatcagaaaaaacaataggagtccttccttgtcttttctgtgatctctgtccttgtttctgagactttctctaccattaagctctattttagctttcagttattctagtttgtttcccatggaatctgtcctaaactggtgtttttgtcagtgacagtcttgccagtcagcaatttctaacagcattttaaatgagtttgatgtacagtaaatattgatgacaatgacagcttttaactcttcaagtcacctaaagctattatgcaggaggatttagaagtcacattcataaaacccaagtgctatgggtgtattattcatgatagctggcccacaggtcatgaattgaggaggaatttgctttcaaaaagcaagaatgtccaacactgaaagtttatagttttatatttggaccttgaaaggtaagaaaaaaccaggttctccaaagttaggaatagggaactaatttatgaaacagccatcttaaaaaaaaaaaaagtaaactg

SEQ ID NO: 288350 - DNA, 1233 bp, Homo sapiens
aatttcttttccccttgaagaagttgatttaggcacagactctggactctggatttcccacaatgtcttatctagtcaactcaagtatctggactacaattttcttgaaagcaaagcccatatattaataatctttacttgtatataaatattcaataaatcattaagtaaatgtgtagaagaattttatgctcaataagatccacccgatcatgcatttgaaaatttatgggtaaaaatggtagttacgggcagaaaacaaggaaaaccatagctcaatttagttcttcattctgccaaaatttgatgtctgtaattcatccttaatacataacccatttattgccttctggcaagaaactggcgcttgctggcactgtgagagcagtgaatccagtaagcttctgccacaggccaaaatgggactccctgacctgaagaacacctctccaatgaataatttaaatctttaacagcctttctgagaaattcattctacttccctcttcaaggatccacctagaactccctcttgctccaacttcctcaacttctgttggcaatgatgtcatgtcttccttctaactagaactttgttttctctcttagaattacctctctgaacaggactttgtgtctgtgtttggcatcacaagagggcaatttgcagctctgcctggctggaaacagctccaaatgaagaaagaaaaggggcttttctaaagcaagaaggcctatacctattgcaaggccacagaaaagagcagatagtgccaatatcaggaaataatttatccaccaatttctgcctgacattcagctacttaatttagatataatagagtctgcaaatcacggcatgttctccattttttctcatccttgcattccttgcttgttatatacctaaaatgttaaccatatagtttttgggttttgtggccctctagctaaagcctcagcagaaagcactaaaactgcataaatctggagaaatcaaaagaaagagaaccaaaaaacaatgcttaaaatgtttaataactttatgtttaatattataccaggacctacctttgttttcaattttaagatgattatttctaaaatctatttagcctgtaaatcattgaaatcatatatgcactccataggcaaaatccaaatacccagatctgtaatgtgtcaaagcatttttcacttttcaaataaagatacctataatgaacaaatgga

SEQ ID NO: 288351 - DNA, 1701 bp, Homo sapiens
  misc_feature (547)..(547): n is a, c, g, or t
aagatacaaaaaaaaattatccaggcatggtggcgcatgccggtagtccaggctacctggcagggcactgagataggaaaatcacttgaacccgggaggctgcagtgagccgagatcacgccacggcactccagcctaggtgagagcgagactctgtctaaaaaaaaaaaaaagcactcagaacagttcttggcacacagtacctgctgaataaaaggtggctgttattattgaaggggatatcacatatcaaggttaatggccctgtcctcaaggagcttatatttgtgcagatccatgcagatgaaccaagccagaagcaataaatgagcaaacaaatgtgatgcaaagtcagtaaggacaaaagtactgaaagaacacagcataatcatcctaaaaattaacaaccataatcaccgcaagccaataaacagatccaaaaatgttccactcagtcatttttttttttaggcaggtaccttggtccttagacaaaagtgagttagaatttgactctgactcccagaggggagacgcttatatcatntggcttcatagaggtgaattaccagacaagcaaagaactcagtgtattccaccactgacctgcctttgggaatgggtggctctgcagggcttcatcaagatgaagagctaccccagcagcaccaatgtggagaccgtcaacgatggtgctgagtcggccatgttcaagcagctgttccagaagtggtcagtaaaggaccagaccatgggcctggggaaaacgttcagcattggtaaaattggtgagactgcccccagatcatcctctcattgctaagactctagaaaagcaggcacagatgcttcttactcactcggcttttcccaaccctttctccacagctaaagttttccaggataaatttgatgtgactctgctacacaccaagccagaggtagctgcccaggaaagaatggtcgatgatggcaacggaaaagttgagatctggactctgcttttcttctctctagggtgggacttccaggaagggaaatgccgagcctgaccctccagtaagactcttccaaattcatggaaatgacaaatctaacaccaaagcagtggaagttccagcctttgcctcctccctaaactccaatgatgtctttctgctgcgaactcaggcagagcactacctgtggtatggcaaggtaggatggctgggccccgggtcagaccagcccctcggagcccagacctgcactcccctcctcctgtcagcaaggtcaaaggacctagagtaggctggagtgcttgctttggcagcacatatactaaaactggaatgatacagagaagattagcatggtccctgtgcaaggatggcatgcaaattcatgaagcgtttgatattaaaaaaaaaaaaaaaaaaaaaaagctgggcacggtggctcatccctgtaatcctagcactttgggaggctgaggcaggcaaatcacgaggtcaggagttcgagaccagcctggccaacatggtgaaaccccatctctactgaaaatacaaaaattagctgggcatggtggcacgcgcccatagtcccagctactcaggaggctgaggcagaagaatctcttgaaccagggggcggaggttgcagtgagccgagattgtaccactgtactccagcctgggcgacagggtgagactccgtctc

SEQ ID NO: 288352 - DNA, 167 bp, Homo sapiens
cattgcagctcagaggaggcagagctgagctgagccagcctgttcacctcctcagagactcagcattgtgaattgaaggcaagaagaaaaagtaaaagaccttggctcatagaaagtcactttaatagatagggacagtaataaataaatgtacaatctctatatac

SEQ ID NO: 288353 - DNA, 2919 bp, Homo sapiens
gtgccagggcagtggcctaatacggaactccatttcccggcgtgctcgcggaggccgctgaactcagaagcgggaggccggttccggttgcatcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaatatatcaaaactcgagactagttctctc

SEQ ID NO: 288354 - DNA, 2889 bp, Homo sapiens
gtgccagggcagtggcctaatacggaactccatttcccggcgtgctcgcggaggccgctgaactcagaagcgggaggccggttccggttgcatcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatac

SEQ ID NO: 288355 - DNA, 843 bp, Homo sapiens
gggaacaccctctatctgtgtgggacagatgagtatggtacagcaacagagaccaaggctctggaggaggcgagagtacctggcaaagacatcggcactgagcacacaaccaatggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggacgctggcggggaggacatagcctaggaagtgactcggacaccccaaagaccaagaacacatcaaccgtacaagagcccgaggataggctcaaagccaacgcagcagtaacaccgagcaactcaaatggggcgaaacccatggaccctgagaaggacaagaagacaaaggcatacaaagacatcggaaggacgccccaaaggcacacaggagcatcacaggcaaacagcacacgaacccgggcgaaaga

SEQ ID NO: 288356 - DNA, 1561 bp, Homo sapiens
agtaaagatgggatttcaccatgttggccaggctggtcttgaactcctgacctcaggtgatccacccacctctggtctcccaaagtgctgggattacaggtgtgagccaccatgcccggcccttaactcattctttaaaaatgagtttttaaaacctttgcttagaagaatctaaacacttctaattccattgtttccaatctagatcaattcactaccatctctaaattactgcagaaactttctgactgcagaaggtcttcccatttcttctcttgccacccctccgcaactctattcaccatacagcagcctgagtgagccttttaaaacaggtcattcctctgctcaaaccctccaatgacttcctatttcatgtcatggaagtcactgaagggttttgagtggaggaattacctaaggtaattcctgaccacctgatgtaccgaaaatcacctccatcctgaacattctccattcctttctctgctttagctttctccgtggcacttatattttgtttactgtaggcctcccactgagatgattttttcctcttgctcaaggatgtaccctgagccccaaactgtgtggcacacagtaggtcctcattaagtatttgttaagaatgaatggataaactccccccagtctctcttatagggaaggggcagaagcagagtggcagctgctgatccctaggggctagagatgcaatattgcccgaagtatttctctgcagggctgtcctccctggggaaccctcccttgccttccagtgtgtgggacttggctttcatcagcagtagagcctcaggtcagaaggctgcagagccaaacggggctggcctgatgcaatggttacacagagattagctgggagacaggaccgggttaaagaggcagggactaatcccgagggaaggacaataccctggggagaccccaaatggcctcctacacttaagagatccaggctgctctcttgtgcaggaggcccagagacctctacggcaaaaggaaaacacaccactccctgtccatcggcacccctcccaaaggcttgtgtctcctcaaggttcccctatccgctgcagggtccagtagccccagctaccaaggtggccatgctgacaccagaggcactgagactgagacagaattgggggtggggtagggagaaggcccgctggtggcgaagcggcggaaacggcctgagcgatggtcacccagtcttagagcgggggtgtgtcctgctgacctgcctccccgcggacaggcctaacgatgaggcctgaagttggctacgggaaagaatgaatttcccaagggcaaccgaggtccctttgcccagcagcacagagcagggcccgtgttccggctccgggcaggggtggagagacgccgtcgtccgaagcaataggggtttgtaagcaccaccccagaataagggactctccccattcctctctcggacggtccctaacttcactgtggaggagtgaggccgatcctaaagagcggacgccccacttgatcaaacccagcctctactagcttt

SEQ ID NO: 288357 - DNA, 2820 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatac

SEQ ID NO: 288358 - DNA, 3658 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaagctgagacctttccttttgtctactccaagccttccccctgcgtatgtgggattgagggtcacatcattggcactagtgagagggtagtcagtagccacttctgggaaaggtgggtagtgtggcccaagtgggggactgatgctcccaattgttcatgcttggtgcagattcaccattcggtcaatcagagctcggcgagtcgcctctacttccctggtcaggcgctcgatttcctgcttgagccgttcattctcttcagctagctgtgccactttcctttcattctcctgttctttctccttcatgcgctgctttccagcccgggctggggaatgaccactctgtttccgtttcctggttctcccttggtcttcctcctcttcctcctgagccagggagctctgactggaatctggagagtgagggctctgggaggtgcttgtgacctctgctggttctggctcctcctcagtcagccaagccagagaagcagggtcaagagtggtgaagatttttgattctcctcttcatttccaggaggtgaaacataggtacccccattttcatctgaagacaggacctcttgcaggtcctcataccaggcttccagctcccagctggacagtgtcccgaaggagaaaggcaatgactcagctgccatctctgcagttggatcagtctggaaaagcacatctgctttcaggtgtggtgatgtatgaagatacacttccttcttgaacactctctcctcaggttccagctctgattttggctctgtcgctgccacccgctcatctttaacatgatacgctcagtgccttagacttaagtctct

SEQ ID NO: 288359 - DNA, 2952 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtgagcagttcttggttaggctgtgcatggggagggtaggcggtagggtgtgggtgttagggttgggtgtctggtcttccttgggcctttgaaggaggtctcaggaaatctctcctaaccacattcccctaggtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatac

SEQ ID NO: 288360 - DNA, 3079 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaaaaaaaaacaaaaaaaaaaacaaaaaagaattctccgagaagagctaattgttctctcactctctcttctcttctcctccccgggtgagaagaactccgggggtgctccccaaggtgggagcgcgacggccacagccgacgtgtgtgggtacccgcggcgttttgggcgaaaaagaccaggcgcgggggaccccagaagagggtctccgctactaggcgcgggggggtgtcccctctgatgggcccaaaaagattacg

SEQ ID NO: 288361 - DNA, 2753 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaaccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatac

SEQ ID NO: 288362 - DNA, 4023 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaagtatgaagcttaagccctgtgggagactggacaagctgaatcctaaatagatctttttcttgcctcactgttacctccccacccccctttatcttagggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaagctgagacctttccttttgtctactccaagccttccccctgcgtatgtgggattgagggtcacatcattggcactagtgagagggtagtcagtagccacttctgggaaaggtgggtagtgtggcccaagtgggggactgatgctcccaattgttcatgcttggtgcagattcaccattcggtcaatcagagctcggcgagtcgcctctacttccctggtcaggcgctcgatttcctgcttgagccgttcattctcttcagctagctgtgccactttcctttcattctcctgttctttctccttcatgcgctgctttccagcccgggctggggaatgaccactctgtttccgtttcctggttctcccttggtcttcctcctcttcctcctgagccagggagctctgactggaatctggagagtgagggctctgggaggtgcttgtgacctctgctggttctggctcctcctcagtcagccaagccagagaagcagggtcaagagtggtgaagatttttgattctcctcttcatttccaggaggtgaaacataggtacccccattttcatctgaagacaggacctcttgcaggtcctcataccaggcttccagctcccagctggacagtgtcccgaaggagaaaggcaatgactcagctgccatctctgcagttggatcagtctggaaaagcacatctgcaggataatggggagtggctggaacaagctccatgtagcaaacagtctatgccacaagttggcaagctggtctgatgcctgtttttgtaggtaaagttgtactggaatacagccacatctgtttatttacatattgtttatggctgctttggtgctacagtggcagagatgaagagtcacgctagagactataggacttttaacatctaaaatatttactgtcctgccgtttaaaatttttggaaaagggtaggttaagtttacctgctttcaggtgtggtgatgtatgaagatacacttccttcttgaacactctctcctcaggttccagctctgattttggctctgtcgctgccacccgctcatctttaacatgatacgctcagtgccttagacttaagtctct

SEQ ID NO: 288363 - DNA, 3863 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaagctgagacctttccttttgtctactccaagccttccccctgcgtatgtgggattgagggtcacatcattggcactagtgagagggtagtcagtagccacttctgggaaaggtgggtagtgtggcccaagtgggggactgatgctcccaattgttcatgcttggtgcagattcaccattcggtcaatcagagctcggcgagtcgcctctacttccctggtcaggcgctcgatttcctgcttgagccgttcattctcttcagctagctgtgccactttcctttcattctcctgttctttctccttcatgcgctgctttccagcccgggctggggaatgaccactctgtttccgtttcctggttctcccttggtcttcctcctcttcctcctgagccagggagctctgactggaatctggagagtgagggctctgggaggtgcttgtgacctctgctggttctggctcctcctcagtcagccaagccagagaagcagggtcaagagtggtgaagatttttgattctcctcttcatttccaggaggtgaaacataggtacccccattttcatctgaagacaggacctcttgcaggtcctcataccaggcttccagctcccagctggacagtgtcccgaaggagaaaggcaatgactcagctgccatctctgcagttggatcagtctggaaaagcacatctgcaggataatggggagtggctggaacaagctccatgtagcaaacagtctatgccacaagttggcaagctggtctgatgcctgtttttgtaggtaaagttgtactggaatacagccacatctgtttatttacatattgtttatggctgctttggtgctacagtggcagagatgaagagtcacgctagagactataggacttttaacatctaaaatatttactgtcctgccgtttaaaatttttggaaaagggtaggttaagtttacctgctttcaggtgtggtgatgtatgaagatacacttccttcttgaacactctctcctcaggttccagctctgattttggctctgtcgctgccacccgctcatctttaacatgatacgctcagtgccttagacttaagtctct

SEQ ID NO: 288364 - DNA, 4177 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccagtgagaaagctaaaggctgtgccctcgctccacaacagccacagcatcacttccctaatttccctaagtagtcctcacccatcactctttccatcttttggccctgccgcttcctcacttacagtttttctttcctgtcttaactagaagagaccttcgacttaaaggtaaccactttccctctgagatgctgtataaaactggaggttaggggatatttatggttgctggtgataactttgttgttctccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaagctgagacctttccttttgtctactccaagccttccccctgcgtatgtgggattgagggtcacatcattggcactagtgagagggtagtcagtagccacttctgggaaaggtgggtagtgtggcccaagtgggggactgatgctcccaattgttcatgcttggtgcagattcaccattcggtcaatcagagctcggcgagtcgcctctacttccctggtcaggcgctcgatttcctgcttgagccgttcattctcttcagctagctgtgccactttcctttcattctcctgttctttctccttcatgcgctgctttccagcccgggctggggaatgaccactctgtttccgtttcctggttctcccttggtcttcctcctcttcctcctgagccagggagctctgactggaatctggagagtgagggctctgggaggtgcttgtgacctctgctggttctggctcctcctcagtcagccaagccagagaagcagggtcaagagtggtgaagatttttgattctcctcttcatttccaggaggtgaaacataggtacccccattttcatctgaagacaggacctcttgcaggtcctcataccaggcttccagctcccagctggacagtgtcccgaaggagaaaggcaatgactcagctgccatctctgcagttggatcagtctggaaaagcacatctgcaggataatggggagtggctggaacaagctccatgtagcaaacagtctatgccacaagttggcaagctggtctgatgcctgtttttgtaggtaaagttgtactggaatacagccacatctgtttatttacatattgtttatggctgctttggtgctacagtggcagagatgaagagtcacgctagagactataggacttttaacatctaaaatatttactgtcctgccgtttaaaatttttggaaaagggtaggttaagtttacctgctttcaggtgtggtgatgtatgaagatacacttccttcttgaacactctctcctcaggttccagctctgattttggctctgtcgctgccacccgctcatctttaacatgatacgctcagtgccttagacttaagtctct

SEQ ID NO: 288365 - DNA, 3867 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaagctgagacctttccttttgtctactccaagccttccccctgcgtatgtgggattgagggtcacatcattggcactagtgagagggtagtcagtagccacttctgggaaaggtgggtagtgtggcccaagtgggggactgatgctcccaattgttcatgcttggtgcagattcaccattcggtcaatcagagctcggcgagtcgcctctacttccctggtcaggcgctcgatttcctgcttgagccgttcattctcttcagctagctgtgccactttcctttcattctcctgttctttctccttcatgcgctgctttccagcccgggctggggaatgaccactctgtttccgtttcctggttctcccttggtcttcctcctcttcctcctgagccagggagctctgactggaatctggagagtgagggctctgggaggtgcttgtgacctctgctggttctggctcctcctcagtcagccaagccagagaagcagggtcaagagtggtgaagatttttgattctcctcttcatttccaggaggtgaaacataggtacccccattttcatctgaagacaggacctcttgcaggtcctcataccaggcttccagctcccagctggacagtgtcccgaaggagaaaggcaatgactcagctgccatctctgcagttggatcagtctggaaaagcacatctgcaggataatggggagtggctggaacaagctccatgtagcaaacagtctatgccacaagttggcaagctggtctgatgcctgtttttgtaggtaaagttgtactggaatacagccacatctgtttatttacatattgtttatggctgctttggtgctacagtggcagagatgaagagtcacgctagagactataggacttttaacatctaaaatatttactgtcctgccgtttaaaatttttggaaaagggtaggttaagtttacctgctttcaggtgtggtgatgtatgaagatacacttccttcttgaacactctctcctcaggttccagctctgattttggctctgtcgctgccacccgctcatctttaacatgatacgctcagtgccttagacttaagtctct

SEQ ID NO: 288366 - DNA, 2786 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatac

SEQ ID NO: 288367 - DNA, 3450 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatgggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaagctgagacctttccttttgtctactccaagccttccccctgcgtatgtgggattgagggtcacatcattggcactagtgagagggtagtcagtagccacttctgggaaaggtgggtagtgtggcccaagtgggggactgatgctcccaattgttcatgcttggtgcagattcaccattcggtcaatcagagctcggcgagtcgcctctacttccctggtcaggcgctcgatttcctgcttgagccgttcattctcttcagctagctgtgccactttcctttcattctcctgttctttctccttcatgcgctgctttccagcccgggctggggaatgaccactctgtttccgtttcctggttctcccttggtcttcctcctcttcctcctgagccagggagctctgactggaatctggagagtgagggctctgggaggtgcttgtgacctctgctggttctggctcctcctcagtcagccaagccagagaagcagggtcaagagtggtgaagatttttgattctcctcttcatttccaggaggtgaaacataggtacccccattttcatctgaagacaggacctcttgcaggtcctcataccaggcttccagctcccagctggacagtgtcccgaaggagaaaggcaatgactcagctgccatctctgcagttggatcagtctggaaaagcacatctgcaggataatggggagtggctggaacaagctccatgtagcaaacagtctatgccacaagttggcaagctggtctgatgcctgtttttgtaggtaaagttgtactggaatacagccacatctgtttatttacatattgtttatggctgctttggtgctacagtggcagagatgaagagtcacgctagagactataggacttttaacatctaaaatatttactgtcctgccgtttaaaatttttggaaaagggtaggttaagtttacctgctttcaggtgtggtgatgtatgaagatacacttccttcttgaacactctctcctcaggttccagctctgattttggctctgtcgctgccacccgctcatctttaacatgatacgctcagtgccttagacttaagtctct

SEQ ID NO: 288368 - DNA, 3072 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccagtgagaaagctaaaggctgtgccctcgctccacaacagccacagcatcacttccctaatttccctaagtagtcctcacccatcactctttccatcttttggccctgccgcttcctcacttacagtttttctttcctgtcttaactagaagagaccttcgacttaaaggtaaccactttccctctgagatgctgtataaaactggaggttaggggatatttatggttgctggtgataactttgttgttctccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatac

SEQ ID NO: 288369 - DNA, 2758 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatac

SEQ ID NO: 288370 - DNA, 2777 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaagtatgaagcttaagccctgtgggagactggacaagctgaatcctaaatagatctttttcttgcctcactgttacctccccacccccctttatcttaggctgttgtaactggagctgttgtaactggagctgttgtaactggagctgttgtaactgagaaattggggccgagctga

SEQ ID NO: 288371 - DNA, 3151 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccagtgagaaagctaaaggctgtgccctcgctccacaacagccacagcatcacttccctaatttccctaagtagtcctcacccatcactctttccatcttttggccctgccgcttcctcacttacagtttttctttcctgtcttaactagaagagaccttcgacttaaaggtaaccactttccctctgagatgctgtataaaactggaggttaggggatatttatggttgctggtgataactttgttgttctccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaacaacgagccacaaacacagcgggggggcggcacacagagaacgccccggagggggcccaagaggaaaggggaaacca

SEQ ID NO: 288372 - DNA, 2792 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtaggtggaagagccagcctctcttaaaattgatactcttgccatgcagcttttggagtgggtgagagaagacctaacatctctccagtgttactttggtcatgggactcctaagtttctgatataaagtccttggtagtcgttcacaagtccggaattatctgtacatcttcattgttcttcatgccagaaaccagaacctggcacacaaaactaactggtaaacagatatttgaagaaacactgtgatcacctagtctccataatgctagcagatagtgggcagggaaaatacaggaaagccatttcctctttgacacaaaatgaaaaagtaagtacattgctaaacttctgga

SEQ ID NO: 288373 - DNA, 1892 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacaggtacctaccattaggatgggaattctaagcccggttggagttttgggaatgcccgacggagtcctctgacttgcgttatctctgatttgctggc

SEQ ID NO: 288374 - DNA, 2568 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaagctgagacctttccttttgtctactccaagccttccccctgcgtatgtgggattgagggtcacatcattggcactagtgagagggtagtcagtagccacttctgggaaaggtgggtagtgtggcccaagtgggggactgatgctcccaattgttcatgcttggtgcagattcaccattcggtcaatcagagctcggcgagtcgcctctacttccctggtcaggcgctcgatttcctgcttgagccgttcattctcttcagctagctgtgccactttcctttcattctcctgttctttctccttcatgcgctgctttccagcccgggctggggaatgaccactctgtttccgtttcctggttctcccttggtcttcctcctcttcctcctgagccagggagctctgactggaatctggagagtgagggctctgggaggtgcttgtgacctctgctggttctggctcctcctcagtcagccaagccagagaagcagggtcaagagtggtgaagatttttgattctcctcttcatttccaggaggtgaaacataggtacccccattttcatctgaagacaggacctcttgcaggtcctcataccaggcttccagctcccagctggacagtgtcccgaaggagaaaggcaatgactcagctgccatctctgcagttggatcagtctggaaaagcacatctgcaggataatggggagtggctggaacaagctccatgtagcaaacagtctatgccacaagttggcaagctggtctgatgcctgtttttgtaggtaaagttgtactggaatacagccacatctgtttatttacatattgtttatggctgctttggtgctacagtggcagagatgaagagtcacgctagagactataggacttttaacatctaaaatatttactgtcctgccgtttaaaatttttggaaaagggtaggttaagtttacctgctttcaggtgtggtgatgtatgaagatacacttccttcttgaacactctctcctcaggttccagctctgattttggctctgtcgctgccacccgctcatctttaacatgatacgctcagtgccttagacttaagtctct

SEQ ID NO: 288375 - DNA, 1729 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggcaatgaggtggctgaccaaggtatagttatcctcagctcctagggctgagcaaggaaagactaagctatggaaaggaacattgtctttggccatgaactgatacaggtccacttgctctgggttcttccaccatctctcccact

SEQ ID NO: 288376 - DNA, 3270 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaaaatggagctggcgctggtgcctgtgagcgcccacggcaacttctatgagggggactgctacgtcatcctctcgacccggagagtggccagtctcctatcccaggacatccacttctggatcgggaaggactcctcccaggatgagcaaagctgcgcagccatatataccacacagctggacgactacctgggaggcagccctgtgcagcaccgagaggtccagtaccatgagtcagacactttccgtggctacttcaagcagggcatcatctacaagcaggggggtgtcgcctctgggatgaagcacgtggagaccaatacctacgacgtgaagcggctgctacatgtgaaagggaaaagaaacatcagggctaccgaggtggaaatgagctgggacagtttcaaccgaggtgatgtcttcttgctggaccttgggaaagtcatcatccaatggaatggcccagagagcaacagtggggagcgcctgaaggctatgcttctggcaaaggatattcgagacagggagcgagggggccgtgctgaaataggagtgatcgagggagacaaggaggcagccagcccagagctgatgaaggtccttcaggacacccttggccgacgctccattatcaagcctacagtccctgatgagatcatagatcagaagcagaaatcaactatcatgttgtatcatatctcagattcagctgggcagctggcagtcacagaggtagcaacaaggcctctggtccaggacttactgaaccatgatgactgctacatcctggaccaaagtggaaccaaaatctacgtgtggaaaggaaaaggagccacaaaggctgaaaaacaggcagccatgtctaaagcgctgggcttcatcaagatgaagagctaccccagcagcaccaatgtggagaccgtcaacgatggtgctgagtcggccatgttcaagcagctgttccagaagtggtcagtaaaggaccagaccatgggcctggggaaaacgttcagcattggtaaaattgctaaagttttccaggataaatttgatgtgactctgctacacaccaagccagaggtagctgcccaggaaagaatggtcgatgatggcaacggaaaagttgaggtctggagaattgagaacctggagctggtccctgtggagtatcaatggtatggcttcttttatgggggagactgttatctggtcctctacacatacgaggtaaatgggaagccacatcacatcttgtacatctggcagggccgccacgcctcacaggatgagctggcagcctcagcataccaggcagtggaggtggatcggcagtttgatggggctgctgtgcaggttcgagtcaggatgggaacggagccacgccacttcatggccatcttcaaagggaagctagttatctttgagggtgggacttccaggaagggaaatgccgagcctgaccctccagtaagactcttccaaattcatggaaatgacaaatctaacaccaaagcagtggaagttccagcctttgcctcctccctaaactccaatgatgtctttctgctgcgaactcaggcagagcactacctgtggtatggcaaggtaggatggctgggccccgggtcagaccagcccctcggagcccagacctgcactcccctcctcctgtcagcaaggtcaaaggacctagagtaggctggagtgcttgctttggcagcacatatactaaaactggaatgatacagagaagattagcatggtccctgtgcaaggatggcatgcaaattcatgaagcgtttgatattaaaaaaaaaaaaaaaaaaaaaaaccccgggggaaccaaagagcgggggggggggaaaagggggtggcacggggccctggggccaagcggttcccggcccccctttcttgtccaggggggaaacc

SEQ ID NO: 288377 - DNA, 3566 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaaaatggagctggcgctggtgcctgtgagcgcccacggcaacttctatgagggggactgctacgtcatcctctcgacccggagagtggccagtctcctatcccaggacatccacttctggatcgggaaggactcctcccaggatgagcaaagctgcgcagccatatataccacacagctggacgactacctgggaggcagccctgtgcagcaccgagaggtccagtaccatgagtcagacactttccgtggctacttcaagcagggcatcatctacaagcaggggggtgtcgcctctgggatgaagcacgtggagaccaatacctacgacgtgaagcggctgctacatgtgaaagggaaaagaaacatcagggctaccgaggtggaaatgagctgggacagtttcaaccgaggtgatgtcttcttgctggaccttgggaaagtcatcatccaatggaatggcccagagagcaacagtggggagcgcctgaaggctatgcttctggcaaaggatattcgagacagggagcgagggggccgtgctgaaataggagtgatcgagggagacaaggaggcagccagcccagagctgatgaaggtccttcaggacacccttggccgacgctccattatcaagcctacagtccctgatgagatcatagatcagaagcagaaatcaactatcatgttgtatcatatctcagattcagctgggcagctggcagtcacagaggtagcaacaaggcctctggtccaggacttactgaaccatgatgactgctacatcctggaccaaagtggaaccaaaatctacgtgtggaaaggaaaaggagccacaaaggctgaaaaacaggcagccatgtctaaagcgctgggcttcatcaagatgaagagctaccccagcagcaccaatgtggagaccgtcaacgatggtgctgagtcggccatgttcaagcagctgttccagaagtggtcagtaaaggaccagaccatgggcctggggaaaacgttcagcattggtaaaattgctaaagttttccaggataaatttgatgtgactctgctacacaccaagccagaggtagctgcccaggaaagaatggtcgatgatggcaacggaaaagttgaggtctggagaattgagaacctggagctggtccctgtggagtatcaatggtatggcttcttttatgggggagactgttatctggtcctctacacatacgaggtaaatgggaagccacatcacatcttgtacatctggcagggccgccacgcctcacaggatgagctggcagcctcagcataccaggcagtggaggtggatcggcagtttgatggggctgctgtgcaggttcgagtcaggatgggaacggagccacgccacttcatggccatcttcaaagggaagctagttatctttgagggtgggacttccaggaagggaaatgccgagcctgaccctccagtaagactcttccaaattcatggaaatgacaaatctaacaccaaagcagtggaagttccagcctttgcctcctccctaaactccaatgatgtctttctgctgcgaactcaggcagagcactacctgtggtatggcaaggggtctagtggggatgagcgggcaatggctaaggagctggccagccttctctgtgatggcagcgagaacactgtggccgagggccaggagccagccgagttctgggacctactgggagggaaaactccctatgccaatgataaaaggtatgggaacacagcctccccctcttctgggctccccctgcctgccaggcttgtgaattgcacaaaggctaaaacctcagttttaaaaacatttctaagcagcttgatgcccttaaatggactatattgcagacttcagcaggaaatcctagatgtccagtctcgtctctttgaatgttccaataagaccggccaattcgttgtcactgagatcacagacttcacccaggatgacctgaaccctactgacgtgatgctcctagatacctgggaccaggtaagacacagctgcagaagtcagaacatgagaaagactcccacagtaagggttgtttttgtgtagtatccccaccctagaataaacccagggtagccctggaccatccccagctcaatcaaacctttgtcagcagtgaccaaaagaaagcccgggttttttttccaggggtgatgtttgagaatgatgtttgaaactca

SEQ ID NO: 288378 - DNA, 3120 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaaaatggagctggcgctggtgcctgtgagcgcccacggcaacttctatgagggggactgctacgtcatcctctcgacccggagagtggccagtctcctatcccaggacatccacttctggatcgggaaggactcctcccaggatgagcaaagctgcgcagccatatataccacacagctggacgactacctgggaggcagccctgtgcagcaccgagaggtccagtaccatgagtcagacactttccgtggctacttcaagcagggcatcatctacaagcaggggggtgtcgcctctgggatgaagcacgtggagaccaatacctacgacgtgaagcggctgctacatgtgaaagggaaaagaaacatcagggctaccgaggtggaaatgagctgggacagtttcaaccgaggtgatgtcttcttgctggaccttgggaaagtcatcatccaatggaatggcccagagagcaacagtggggagcgcctgaaggctatgcttctggcaaaggatattcgagacagggagcgagggggccgtgctgaaataggagtgatcgagggagacaaggaggcagccagcccagagctgatgaaggtccttcaggacacccttggccgacgctccattatcaagcctacagtccctgatgagatcatagatcagaagcagaaatcaactatcatgttgtatcatatctcagattcagctgggcagctggcagtcacagaggtagcaacaaggcctctggtccaggacttactgaaccatgatgactgctacatcctggaccaaagtggaaccaaaatctacgtgtggaaaggaaaaggagccacaaaggctgaaaaacaggcagccatgtctaaagcgctgggcttcatcaagatgaagagctaccccagcagcaccaatgtggagaccgtcaacgatggtgctgagtcggccatgttcaagcagctgttccagaagtggtcagtaaaggaccagaccatgggcctggggaaaacgttcagcattggtaaaattgctaaagttttccaggataaatttgatgtgactctgctacacaccaagccagaggtagctgcccaggaaagaatggtcgatgatggcaacggaaaagttgaggtctggagaattgagaacctggagctggtccctgtggagtatcaatggtatggcttcttttatgggggagactgttatctggtcctctacacatacgaggtaaatgggaagccacatcacatcttgtacatctggcagggccgccacgcctcacaggatgagctggcagcctcagcataccaggcagtggaggtggatcggcagtttgatggggctgctgtgcaggttcgagtcaggatgggaacggagccacgccacttcatggccatcttcaaagggaagctagttatctttgagggtgggacttccaggaagggaaatgccgagcctgaccctccagtaagactcttccaaattcatggaaatgacaaatctaacaccaaagcagtggaagttccagcctttgcctcctccctaaactccaatgatgtctttctgctgcgaactcaggcagagcactacctgtggtatggcaaggggtctagtggggatgagcgggcaatggctaaggagctggccagccttctctgtgatggcagcgagaacactgtggccgagggccaggagccagccgagttctgggacctactgggagggaaaactccctatgccaatgataaaagacttccgcagggacccaagtcgggccgagta

SEQ ID NO: 288379 - DNA, 920 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtatgttgccgtggctggagaaggatggctatacatgcctcctactacatgcccactggacatatgtggctaagcatgcttcagattgctcgcatgaacttttggga

SEQ ID NO: 288380 - DNA, 120 bp, Homo sapiens
cctggaagcggattaaaggcagtgaggctgacaggtaggtaagcggggagggttggctaaaggcataaagtggcttgtaagctgtatcctcctggaggtcttgactaatgtctcctcttc

SEQ ID NO: 288381 - DNA, 649 bp, Homo sapiens
aatgagactgttcgtgagtgatggcgtcccgggttgcttgccggtgctggccgccgccgggagagcccggggcagagcagaggtgctcatcagcactgtaggcccggaaggtactcgtgctggtgctggtgggcggtggatgggggggcgggaccgaaacacgccagattctctgcagctgtctttgccaaacccctagccctcgccacacaccccaatcggccacttctcctattatccttgatcactccacgccttcttccctcccagtcacatctttcacttcctttaattaccctcaatataatacccttcccttatctctctcctcccctcttccgtcttcccggtccccgcctcaccccagtaaactgctcttcccttcccaaccttctcctacacctatcaggcatccccctctgctctttagttactagcatgacagcccccaggcacccttttgtgttcttaggaaatccctctctcccctcctaacacacacacacgttcctttctgtttacctcttctcattctcagccgattgtttgggtgactcttaggaggttctcttgtaagtcttctcagttcttttaattttgttctcccactgtgaccttcagataattatgaagatatcccagttacttt

SEQ ID NO: 288382 - DNA, 460 bp, Homo sapiens
ttggcaaatcacttaatctctctaatcctcaatttttttcagttgtgaaatgggataatattagtacctatctcagtgagttattgtgaggattaagtgagatcatataaagtgcttaatacagtgcttgacatataaagtgctcagtaaatgttagatattaccattgggaagaaactgagtgtctcatttgtgtacattttccttttctatccccaacaaaggagacagaatctctagccgacattgttttgtggggagccctatacccattactgcaagatcccgcctacctccctggtgagaactgtgcatatcactccaaccctaggagcttggtgtaggggttacagaatgggcagtagaatactgagaactcccttcaaggtacagcttgactgggcaactatagcagaagatggttgagggaactggggaaagcaactggagaaacctcaca

SEQ ID NO: 288383 - DNA, 347 bp, Homo sapiens
tccttcaaggaaatgaggaaagggaacatagatattagttgagaagggaaaggtaacatccccctttagctttagggctaacattcttacctctcttcatttccaggaggtgaaacataggtacccccattttcatctgaagacaggacctcttgcaggtcctcataccaggcttccagctcccagctggacagtgtcccgaaggagaaaggcaatgactcagctgccatctctgcagttggatcagtctggaaaagcacatctgcaggataatggggagtggctggaacaagctccatgtagcaaacagtctatgccacaagttggcaagctggtctgatgcctgt

SEQ ID NO: 288384 - DNA, 379 bp, Homo sapiens
tgaaatgtcttctgactccctggctcttttgcttttcctgaagacacagaccagacctaagatgtccctcccctataagaaagacctcatcctgtgttttctctctcttcttctcaggcaggaaaaacatatgaacaattaaaagaagagctgggagatgctgctgctatcatgcgaatcactgctgtgagtcgggttcgctcttgggagaagccagccacatgggcaaccagagccagagaacacacaaatgctacagatgctcacaggcaaaactcatgtccttagtattaccatagttgtctgttttgatgtaaagactttttgtaatcaatagaaaagcaggtctcagagccaagttccttattttcctgacttc

SEQ ID NO: 288385 - DNA, 2824 bp, Homo sapiens
ctcccaccttacggctaggtacgagcctgggtagaatcggccgatgagaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatac

SEQ ID NO: 288386 - DNA, 889 bp, Homo sapiens
gtgccagggcagtggcctaatacggaactccatttcccggcgtgctcgcggaggccgctgaactcagaagcgggaggccggttccggttgcatcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggtaccctatctgaggaggagatcgcaaaggtgacaagtgggaaagggccaaaatttgaccatgatgccaacaaaacggtggcatgagggaagaatggaac

SEQ ID NO: 288387 - DNA, 3925 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaagctgagacctttccttttgtctactccaagccttccccctgcgtatgtgggattgagggtcacatcattggcactagtgagagggtagtcagtagccacttctgggaaaggtgggtagtgtggcccaagtgggggactgatgctcccaattgttcatgcttggtgcagattcaccattcggtcaatcagagctcggcgagtcgcctctacttccctggtcaggcgctcgatttcctgcttgagccgttcattctcttcagctagctgtgccactttcctttcattctcctgttctttctccttcatgcgctgctttccagcccgggctggggaatgaccactctgtttccgtttcctggttctcccttggtcttcctcctcttcctcctgagccagggagctctgactggaatctggagagtgagggctctgggaggtgcttgtgacctctgctggttctggctcctcctcagtcagccaagccagagaagcagggtcaagagtggtgaagatttttgattctcctcttcatttccaggaggtgaaacataggtacccccattttcatctgaagacaggacctcttgcaggtcctcataccaggcttccagctcccagctggacagtgtcccgaaggagaaaggcaatgactcagctgccatctctgcagttggatcagtctggaaaagcacatctgcaggataatggggagtggctggaacaagctccatgtagcaaacagtctatgccacaagttggcaagctggtctgatgcctgtttttgtaggtaaagttgtactggaatacagccacatctgtttatttacatattgtttatggctgctttggtgctacagtggcagagatgaagagtcacgctagagactataggacttttaacatctaaaatatttactgtcctgccgtttaaaatttttggaaaagggtaggttaagtttacctgctttcaggtgtggtgatgtatgaagatacacttccttcttgaacactctctcctcaggttccagctctgattttggctctgtcgctgccacccgctcatctttaacatgatacgctcagtgccttagacttaagtctct

SEQ ID NO: 288388 - DNA, 3217 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacaggtaagtaccctggaagactactgatggggtgttcataggaaatgaggggtgaggcagtacttggaaaaagatcttggagagctgctatcttgagttaggagttgagctgaaataggaaataattaaaatgagaactcaacctagagaaacgaacaagaacctgaagaaagcaaaagtctaaagctaaaactctttagtagatataagcaaagagaaaaaagggccagaatggataggaagggactcccaaaatctgagcataccagccccttaaggagaaatgttgctagacacccatagttgaggttagaaagaggaaagaaggaagagttagtgggctagagaggggaaggatgtgatgtgagcagatggttctcactcattctcctctgtccagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatac

SEQ ID NO: 288389 - DNA, 2773 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatac

SEQ ID NO: 288390 - DNA, 3349 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtgagcagttcttggttaggctgtgcatggggagggtaggcggtagggtgtgggtgttagggttgggtgtctggtcttccttgggcctttgaaggaggtctcaggaaatctctcctaaccacattcccctaggtggacctgtatcagttcatggccaaagacaatgttcctttccatagcttagtctttccttgctcagccctaggagctgaggataactataccttggtcagccacctcattgctacaggtaagtaccctggaagactactgatggggtgttcataggaaatgaggggtgaggcagtacttggaaaaagatcttggagagctgctatcttgagttaggagttgagctgaaataggaaataattaaaatgagaactcaacctagagaaacgaacaagaacctgaagaaagcaaaagtctaaagctaaaactctttagtagatataagcaaagagaaaaaagggccagaatggataggaagggactcccaaaatctgagcataccagccccttaaggagaaatgttgctagacacccatagttgaggttagaaagaggaaagaaggaagagttagtgggctagagaggggaaggatgtgatgtgagcagatggttctcactcattctcctctgtccagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatac

SEQ ID NO: 288391 - DNA, 3166 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaagctgagacctttccttttgtctactccaagccttccccctgcgtatgtgggattgagggtcacatcattggcactagtgagagggtagtcagtagccacttctgggaaaggtgggtagtgtggcccaagtgggggactgatgctcccaattgttcatgcttggtgcagattcaccattcggtcaatcagagctcggcgagtcgcctctacttccctggtcaggcgctcgatttcctgcttgagccgttcattctcttcagctagctgtgccactttcctttcattctcctccaagccagccgggttctccagtttggccgacgcgtgggtcgacccacgcgtcc

SEQ ID NO: 288392 - DNA, 2850 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaatatatcaaaactcgagactagttctctc

SEQ ID NO: 288393 - DNA, 2899 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaacaacgagccacaaacacagcgggggggcggcacacagagaacgccccggagggggcccaagaggaaaggggaaacca

SEQ ID NO: 288394 - DNA, 2874 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctactcttcatttccaggaggtgaaacataggtacccccattttcatctgaagacaggacctcttgcaggtcctcataccaggcttccagctcccagctggacagtgtcccgttaggagctttgcctgggaatcctgctgggtcagctc

SEQ ID NO: 288395 - DNA, 2762 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatac

SEQ ID NO: 288396 - DNA, 2958 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaagtatgaagcttaagccctgtgggagactggacaagctgaatcctaaatagatctttttcttgcctcactgttacctccccacccccctttatcttagggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaaaaaaaagtcgacgcggccgctaatttagtagtagtagt

SEQ ID NO: 288397 - DNA, 3559 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccagtgagaaagctaaaggctgtgccctcgctccacaacagccacagcatcacttccctaatttccctaagtagtcctcacccatcactctttccatcttttggccctgccgcttcctcacttacagtttttctttcctgtcttaactagaagagaccttcgacttaaaggtaaccactttccctctgagatgctgtataaaactggaggttaggggatatttatggttgctggtgataactttgttgttctccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctactcttcatttccaggaggtgaaacataggtacccccattttcatctgaagacaggacctcttgcaggtcctcataccaggcttccagctcccagctggacagtgtcccgaaggagaaaggcaatgactcagctgccatctctgcagttggatcagtctggaaaagcacatctgcaggataatggggagtggctggaacaagctccatgtagcaaacagtctatgccacaagttggcaagctggtctgatgcctgtttttgtaggtaaagttgtactggaatacagccacatctgtttatttacatattgtttatggctgctttggtgctacagtggcagagatgaagagtcacgctagagactataggacttttaacatctaaaatatttactgtcctgccgtttaaaatttttggaaaagggtaggttaagtttacctgctttcaggtgtggtgatgtatgaagatacacttccttcttgaacactctctcctcaggttccagctctgattttggctctgtcgctgccacccgctcatctttaacatgatacgctcagtgccttagacttaagtctct

SEQ ID NO: 288398 - DNA, 2986 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccagtgagaaagctaaaggctgtgccctcgctccacaacagccacagcatcacttccctaatttccctaagtagtcctcacccatcactctttccatcttttggccctgccgcttcctcacttacagtttttctttcctgtcttaactagaagagaccttcgacttaaaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatac

SEQ ID NO: 288399 - DNA, 2345 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatgggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatac

SEQ ID NO: 288400 - DNA, 1933 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttgggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatac

SEQ ID NO: 288401 - DNA, 4374 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaaaatggagctggcgctggtgcctgtgagcgcccacggcaacttctatgagggggactgctacgtcatcctctcgacccggagagtggccagtctcctatcccaggacatccacttctggatcgggaaggactcctcccaggatgagcaaagctgcgcagccatatataccacacagctggacgactacctgggaggcagccctgtgcagcaccgagaggtccagtaccatgagtcagacactttccgtggctacttcaagcagggcatcatctacaagcaggggggtgtcgcctctgggatgaagcacgtggagaccaatacctacgacgtgaagcggctgctacatgtgaaagggaaaagaaacatcagggctaccgaggtggaaatgagctgggacagtttcaaccgaggtgatgtcttcttgctggaccttgggaaagtcatcatccaatggaatggcccagagagcaacagtggggagcgcctgaaggctatgcttctggcaaaggatattcgagacagggagcgagggggccgtgctgaaataggagtgatcgagggagacaaggaggcagccagcccagagctgatgaaggtccttcaggacacccttggccgacgctccattatcaagcctacagtccctgatgagatcatagatcagaagcagaaatcaactatcatgttgtatcatatctcagattcagctgggcagctggcagtcacagaggtagcaacaaggcctctggtccaggacttactgaaccatgatgactgctacatcctggaccaaagtggaaccaaaatctacgtgtggaaaggaaaaggagccacaaaggctgaaaaacaggcagccatgtctaaagcgctgggcttcatcaagatgaagagctaccccagcagcaccaatgtggagaccgtcaacgatggtgctgagtcggccatgttcaagcagctgttccagaagtggtcagtaaaggaccagaccatgggcctggggaaaacgttcagcattggtaaaattgctaaagttttccaggataaatttgatgtgactctgctacacaccaagccagaggtagctgcccaggaaagaatggtcgatgatggcaacggaaaagttgaggtctggagaattgagaacctggagctggtccctgtggagtatcaatggtatggcttcttttatgggggagactgttatctggtcctctacacatacgaggtaaatgggaagccacatcacatcttgtacatctggcagggccgccacgcctcacaggatgagctggcagcctcagcataccaggcagtggaggtggatcggcagtttgatggggctgctgtgcaggttcgagtcaggatgggaacggagccacgccacttcatggccatcttcaaagggaagctagttatctttgagggtgggacttccaggaagggaaatgccgagcctgaccctccagtaagactcttccaaattcatggaaatgacaaatctaacaccaaagcagtggaagttccagcctttgcctcctccctaaactccaatgatgtctttctgctgcgaactcaggcagagcactacctgtggtatggcaaggggtctagtggggatgagcgggcaatggctaaggagctggccagccttctctgtgatggcagcgagaacactgtggccgagggccaggagccagccgagttctgggacctactgggagggaaaactccctatgccaatgataaaaggtatgggaacacagcctccccctcttctgggctccccctgcctgccaggcttgtgaattgcacaaaggctaaaacctcagttttaaaaacatttctaagcagcttgatgcccttaaatggactatattgcagacttcagcaggaaatcctagatgtccagtctcgtctctttgaatgttccaataagaccggccaattcgttgtcactgagatcacagacttcacccaggatgacctgaaccctactgacgtgatgctcctagatacctgggaccaggtgttcttgtggattggggctgaggccaatgccacggagaaggagagtgcccttgccacagcacagcagtacctgcacactcaccccagcggccgagatcccgacacaccaatcctgatcattaagcaggggtttgagcctcccatcttcacaggctggttcctagcctgggaccctaacatttggagtgcaggaaaaacatatgaacaattaaaagaagagctgggagatgctgctgctatcatgcgaatcactgctgacatgaagaatgcaaccctctccctgaattctaatgacagtgagccaaaatattaccctatagcagttctgttgaaaaaccagaatcaggagctgcctgaggatgtaaaccctgccaaaaaggagaattacctctctgaacaggactttgtgtctgtgtttggcatcacaagagggcaatttgcagctctgcctggctggaaacagctccaaatgaagaaagaaaaggggcttttctaaagcaagaaggcctatacctattgcaaggccacagaaaagagcagatagtgccaatatcaggaaataatttatccaccaatttctgcctgacattcagctacttaatttagatataatagagtctgcaaatcacggcatgttctccattttttctcatccttgcattccttgcttgttatatacctaaaatgttaaccatatagtttttgggttttgtggccctctagctaaagcctcagcagaaagcactaaaactgcataaatctggagaaatcaaaagaaagagaaccaaaaaacaatgcttaaaatgtttaataactttatgtttaatattataccaggacctacctttgttttcaattttaagatgattatttctaaaatctatttagcctgtaaatcattgaaatcatatatgcactccataggcaaaatccaaatacccagatctgtaatgtgtcaaagcatttttcacttttcaaataaagatacctataatgaacaaatgga

SEQ ID NO: 288402 - DNA, 3447 bp, Homo sapiens
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaaaatggagctggcgctggtgcctgtgagcgcccacggcaacttctatgagggggactgctacgtcatcctctcgacccggagagtggccagtctcctatcccaggacatccacttctggatcgggaaggactcctcccaggatgagcaaagctgcgcagccatatataccacacagctggacgactacctgggaggcagccctgtgcagcaccgagaggtccagtaccatgagtcagacactttccgtggctacttcaagcagggcatcatctacaagcaggggggtgtcgcctctgggatgaagcacgtggagaccaatacctacgacgtgaagcggctgctacatgtgaaagggaaaagaaacatcagggctaccgaggtggaaatgagctgggacagtttcaaccgaggtgatgtcttcttgctggaccttgggaaagtcatcatccaatggaatggcccagagagcaacagtggggagcgcctgaaggctatgcttctggcaaaggatattcgagacagggagcgagggggccgtgctgaaataggagtgatcgagggagacaaggaggcagccagcccagagctgatgaaggtccttcaggacacccttggccgacgctccattatcaagcctacagtccctgatgagatcatagatcagaagcagaaatcaactatcatgttgtatcatatctcagattcagctgggcagctggcagtcacagaggtagcaacaaggcctctggtccaggacttactgaaccatgatgactgctacatcctggaccaaagtggaaccaaaatctacgtgtggaaaggaaaaggagccacaaaggctgaaaaacaggcagccatgtctaaagcgctgggcttcatcaagatgaagagctaccccagcagcaccaatgtggagaccgtcaacgatggtgctgagtcggccatgttcaagcagctgttccagaagtggtcagtaaaggaccagaccatgggcctggggaaaacgttcagcattggtaaaattgctaaagttttccaggataaatttgatgtgactctgctacacaccaagccagaggtagctgcccaggaaagaatggtcgatgatggcaacggaaaagttgaggtctggagaattgagaacctggagctggtccctgtggagtatcaatggtatggcttcttttatgggggagactgttatctggtcctctacacatacgaggtaaatgggaagccacatcacatcttgtacatctggcagggccgccacgcctcacaggatgagctggcagcctcagcataccaggcagtggaggtggatcggcagtttgatggggctgctgtgcaggttcgagtcaggatgggaacggagccacgccacttcatggccatcttcaaagggaagctagttatctttgagggtgggacttccaggaagggaaatgccgagcctgaccctccagtaagactcttccaaattcatggaaatgacaaatctaacaccaaagcagtggaagttccagcctttgcctcctccctaaactccaatgatgtctttctgctgcgaactcaggcagagcactacctgtggtatggcaaggtaggatggctgggccccgggtcagaccagcccctcggagcccagacctgcactcccctcctcctgtcagcaaggtcaaaggacctagagtaggctggagtgcttgctttggcagcacatatactaaaactggaatgatacagagaagattagcatggtccctgtgcaaggatggcatgcaaattcatgaagcgtttgatattaaaaaaaaaaaaaaaaaaaaaaagctgggcacggtggctcatccctgtaatcctagcactttgggaggctgaggcaggcaaatcacgaggtcaggagttcgagaccagcctggccaacatggtgaaaccccatctctactgaaaatacaaaaattagctgggcatggtggcacgcgcccatagtcccagctactcaggaggctgaggcagaagaatctcttgaaccagggggcggaggttgcagtgagccgagattgtaccactgtactccagcctgggcgacagggtgagactccgtctc

SEQ ID NO: 288403 - DNA, 1684 bp, Homo sapiens
  misc_feature (1603)..(1603): n is a, c, g, or t
agtatgatacgccgtgccggtgttatttcattcacgaggcgagcaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggagacaggatttatgctggttgtgccatatgtattgcataagcactccgacaggagagtgtgagacaagagngctgtagtatgcagcatgtctcatgtagctctgtactaagcggacttctgagccatgacggctattagtgatcagccgggg

SEQ ID NO: 288404 - DNA, 781 bp, Homo sapiens
ttaaagaggcagggactaatcccgagggaaggacaataccctggggagaccccaaatggcctcctacacttaagagatccaggctgctctcttgtgcaggaggcccagagacctctacggcaaaaggaaaacacaccactccctgtccatcggcacccctcccaaaggcttgtgtctcctcaaggttcccctatccgctgcagggtccagtagccccagctaccaaggtggccatgctgacaccagaggcactgagactgagacagaattgggggtggggtagggagaaggcccgctggtggcgaagcggcggaaacggcctgagcgatggtcacccagtcttagagcgggggtgtgtcctgctgacctgcctccccgcggacaggcctaacgatgaggcctgaagttggctacgggaaagaatgaatttcccaagggcaaccgaggtccctttgcccagcagcacagagcagggcccgtgttccggctccgggcaggggtggagagacgccgtcgtccgaagcaataggggtttgtaagcaccaccccagaataagggactctccccattcctctctcggacggtccctaacttcactgtggaggagtgaggccgatcctaaagagcggacgccccaactttgaggagacgggagggtaaaaggtagatgggaatcagtactcgcctctctcctcaggttccagctctgattttggctctgtcgctgccacccgctcatctttaacatgatacgctcagtgccttagacttaagtctctg

SEQ ID NO: 288405 - DNA, 2721 bp, Homo sapiens
gcagatttttggtttctgtaactaaaattcttatgaaagagtgatgttaaaattcacttaaaaacatgaagggacaagaacagacaaggaaaatttgaagaactctctgggaacagggcttccctactagataccaagacagactaaagttacaatggttaagacaacaggatattagagaagccaatggaatagaagagcacagaacaaacctacgcaatttgattacataaaaattaaatttttaattttttaaattaaaaattaaacaacaacaaaaacaacttccatttaacaagacaggacaaatagtgtctttgggaaaagcctttgtgaacctaccttatttaaaaataaagctgcttctaaactaataacatttaggtcaagctactcaatagtagaaatgattatacagaagtagtatagcttggtggttgaaatacagatgctggcatcagacttactgggtgtgtgtcctggttctgttacctaattgttgtgtgactctgatgagcaagttattctgcttcagtttccctatttgtcaaatggagacaaatactgtggcattgtggggattaaatcaattaacaactgtaaagtgccctggtataatgatgatgtatttgttatcagggttcgagtgtcattaaggattgttactgttatcattgcatcactactgttaccttacgtttacataacactttacaaattttcaaccatttttcatctctgccatctcattctaccatcagagcacctacatggatacagagatagaaggttccagcttacagtaaccatgagcctggtttttcaactataaaatgagaggataatcaccaaggctccttttggctctaaaaactcatttctattttacaagaaagaaatttgaggcaaagagatattaactgacttgccttaggtcatagacaagttactagcagttaggattaaaacctaggtatcccagattaatttgcatttcaaagatataataataataatttccccagactctccctgtatctaaatttcttcttggaattgtaagcagatacttaggaaggtaattcacttggggaccatttagaatattacagatacattccaatgactagaagcacctaactcattactagggagagagggagtggagatatatatcttttgtgaacaacattaacacaggtaatggtaataccagtaataataaaggagaaagaattacctgggcaagcagacctggttggatctgaagaggctgagctcctggggcttgagtgacgatgggaactgcattttccattcgcaccgagtagccagcgtgcttagagggagaggcctgcaagcctgttccagacagtgtgagggagagaagggttagctgagacgctgtgaacagctggatgaaaagaaccttcctgggcagttatgtcaactttctgcttccctttgcactggtcactgacaacaaccaggtattgcctggtccttggaagtctcccctttggcttctaacaaattaaaaaacaaaactcctcctgaaatcttgaatgtcttcaaaggctagaaggtcagattaaggaggctgtaaggccaaaagtaggacagatatgctcgcagattacaacaggaaaacaagggcttctgaccatcaagatgtacctgtgtatgtcaaaatgaggggtgttggggagatgtatgaacccatttggaattgcattgactgtaaccacacagtttacaccatgaggcttgcaaaaataaattcttaagctttctgggtaaattgtaacaaagtacacagtctagcttcttagagtctacaggagaggagtgctggggtcatggccaaagaattgttttgaggaggggtcccagggaagtacttttcagactgatggatattcttcatgggagctgggactatgtcggctgtcagagattggcagttttctacagataacccacacagaggatatttcatgcgaggaaaagcaagagctgacatcagcataacaatgaaagcacaaactatgtacttatttacagacagctggccagggacacagtccctggcaggtgtgagagtcacaaaggattgacttggtgctgaggcataagccctattgtttctaggttggccacagtaggagaggagccctctagttcagtgataccagcgctctcactggaagaaatgaggagggcctttctccatgaaaatgagcgtgacagaaaactgcaggtgccggagccccagaggccgttctgtaagaagcagaaaaagacatcacttgagactgaacttgcatgaaaaatgaggctgtataaggaaaataaattccaactttggaattctccagtttcccctatcttagccttcatactgatcctttagcaagataggtggttaccagtggtttcacattcagcactgtctacaagaggttttgcctctagaagttacaaggaccagggaatacataggaagaaaccacgaagatatcttggacacaaatagaatttcaagtagggtgtgtatggatgtcacatttgataaaaaggacaaagtcttattttacatatgttttctatacttagattttgtgctaaatttcattgcaaagcaaattgatttgtttgaaaataatcacgaaattgagtggcacagatgtctgattttaagccacatattttaaagtgggt

SEQ ID NO: 288406 - DNA, 2630 bp, Homo sapiens
gcagatttttggtttctgtaactaaaattcttatgaaagagtgatgttaaaattcacttaaaaacatgaagggacaagaacagacaaggaaaatttgaagaactctctgggaacagggcttccctactagataccaagacagactaaagttacaatggttaagacaacaggatattagagaagccaatggaatagaagagcacagaacaaacctacgcaatttgattacataaaaattaaatttttaattttttaaattaaaaattaaacaacaacaaaaacaacttccatttaacaagacaggacaaatagtgtctttgggaaaagcctttgtgaacctaccttatttaaaaataaagctgcttctaaactaataacatttaggtcaagctactcaatagtagaaatgattatacagaagtagtatagcttggtggttgaaatacagatgctggcatcagacttactgggtgtgtgtcctggttctgttacctaattgttgtgtgactctgatgagcaagttattctgcttcagtttccctatttgtcaaatggagacaaatactgtggcattgtggggattaaatcaattaacaactgtaaagtgccctggtataatgatgatgtatttgttatcagggttcgagtgtcattaaggattgttactgttatcattgcatcactactgttaccttacgtttacataacactttacaaattttcaaccatttttcatctctgccatctcattctaccatcagagcacctacatggatacagagatagaaggttccagcttacagtaaccatgagcctggtttttcaactataaaatgagaggataatcaccaaggctccttttggctctaaaaactcatttctattttacaagaaagaaatttgaggcaaagagatattaactgacttgccttaggtcatagacaagttactagcagttaggattaaaacctaggtatcccagattaatttgcatttcaaagatataataataataatttccccagactctccctgtatctaaatttcttcttggaattgtaagcagatacttaggaaggtaattcacttggggaccatttagaatattacagatacattccaatgactagaagcacctaactcattactagggagagagggagtggagatatatatcttttgtgaacaacattaacacaggtaatggtaataccagtaataataaaggagaaagaattacctgggcaagcagacctggttggatctgaagaggctgagctcctggggcttgagtgacgatgggaactgcattttccattcgcaccgagtagccagcgtgcttagagggagaggcctgcaagcctgttccagacagtgtgagggagagaagggttagctgagacgctgtgaacagctggatgaaaagaaccttcctgggcagttatgtcaactttctgcttccctttgcactggtcactgacaacaaccaggtattgcctggtccttggaagtctcccctttggcttctaacaaattaaaaaacaaaactcctcctgaaatcttgaatgtcttcaaaggctagaaggtcagattaaggaggctgtaaggccaaaagtaggacagatatgctcgcagattacaacaggaaaacaagggcttctgaccatcaagatgtacctgtgtatgtcaaaatgaggggtgttggggagatgtatgaacccatttggaattgcattgactgtaaccacacagtttacaccatgaggcttgcaaaaataaattcttaagctttctgggtaaattgtaacaaagtacacagtctagcttcttagagtctacaggagaggagtgctggggtcatggccaaagaattgttttgaggaggggtcccagggaagtacttttcagactgatggatattcttcatgggagctgggactatgtcggctgtcagagattggcagttttctacagataacccacacagaggatatttcatgcgaggaaaagcaagagctgacatcagcataacaatgaaagcacaaactatgtacttatttacagacagctggccagggacacagtccctggcaggtgtgagagtcacaaaggattgacttggtgctgaggcataagccctattgtttctaggttggccacagtaggagaggagccctctagttcagtgataccagcgctctcactggaagaaatgaggagggcctttctccatgaaaatgagcgtgacagaaaactgcaggtgccggagccccagaggccgttctgtaagaagcaggtgagaggctgtggctgctcaatcttaccttggaagccggggggacacacgatgagagcttgctggaacgggtcaggccgggcacaaatctgggctgttcctgtctgcaggggcatgctccgctgggccactgcagccatggatgccgctgagggctggtagagtgtagatgggtagtttagtatggagacttcgggattggctaaggaaatagtggcactggtagaggagggagcctaaaggagtgatggggattaaacaaaaataaacaaaaataaaaaatgagggaggtggcatgttgggagacacgaatctaaatcaaataaatgaactc

SEQ ID NO: 288407 - DNA, 6035 bp, Homo sapiens
agggcggggctcgggccggtccgcccgcgcgcaggtgagtgagccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcaataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaaaccataagctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccgacaagaggcctccaggcagggtctgacggtgtcctttataccttatttcaaagaggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctctaactgcagccccacgagcggcaagcagctagacctgctcttctcggtgacacttaccccaaggactgtggacttgactgtcatcctcatcgcagcggtgggaggtggagtcttactgctgtctgccctcgggctcatcatttgctgtgtgaaaaagaagaaaaagaagacaaacaagggccccgctgtgggtatctacaatggcaacatcaatactgagatgccgaggcagccaaaaaagtttcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataacttgatccattccagacgctttgctgagtttcataaagcagggcactgagacacccgtccgtgttcctaaccagaaatcctaaagaagaggaattatacagaaggaacagcaggaggttttcctggacaccgccaacttcacattgctcagtggactcattctaagggcaagacattgaaaatgatgaattccaatctggatacagtcatgacagctcatgtgctcctcaacttaggctgtgcggttagccagcctgtaatgagaggagagaggcctgagtcacctagcatagggttgcagcaagccctggattcagagtgttaaacagaggcttgccctcttcaggacaacagttccaattccaaggagcctacctgaggtccctactctcactggggtccccaggatgaaaacgacaatgtgcctttttattattatttatttggtggtcctgtgttatttaagagatcaaatgtataaccacctagctcttttcacctgacttagtaataactcatactaactggtttggatgcctgggttgtgacttctactgaccgctagataaacgtgtgcctgtcccccaggtggtgggaataatttacaatctgtccaaccagaaaagaatgtgtgtgtttgagcagcattgacacatatctgctttgataagagacttcctgattctctaggtcggttcgtggttatcccattgtggaaattcatcttgaatcccattgtcctatagtcctagcaataagagaaatttcctcaagtttccatgtgcggttctcctagctgcagcaatactttgacatttaaagagaaatttagagaatattctcatcctctaaaaatgtttaaatatataccaaacagtggccccctgcattagttttctgttgccactgcaacccattacttggtagcttaaaaacaacacattagcttatagtcctggggatcagaattccaaaatggatgtccctgaatgaaaatcaaggtgtcagcagagctgtgctccttctgaaggctctagggagaagccggttccttgccatttcaagcttctagaggctggctgcattcccaggctccagtggctggtcaagcttttctcacatggcatcactgtgacactggccctcccacttccctctttgacttacaaagcccaccaggaagatccaggataatctctccatctaaagatccttcatcatcctggaagagccttttgccatgcaagacaacatagccacaggtggggattaggaccaggacatctttggggtgctgttattctgcctaccacaccttcctgccactgactcccacaggagaggctacaaaatgatctggcgcacagggatgttttgtttagcttgcggactctaacacttaaaaaaaaccccagatcagaagatctggccatgctggggctcacattctcacctagcaacaactggctggagctgggcaccagctctgcctttagaaggggtgtccacttcaccaggtcaccacagcccacactacgccctatcacttcccacaatgaggctgagtgtttgtttctactgatcaatgcccctgcaggttgcatttattgtaatgaaaaagaaagactgggattaatctctaatcaggtgagtagaccatgagaccaatgtgtgctcacattaccctttttcttttttttctttttctttttctttttttttttaatgtgagacaggatctcattctgttgcctaggctggagtgcagtggcgcaatctcggctcactgcaacctctgcctcctgggctcaagcaattctcccacctcagcctcccaaatagctgggatcactggcacaaaccaccatgcccagctaattttgtattttttgtagagacagggtttcaccatgttgcccaggctggtctcaacctcctgggctcaagcaatcctcctgcctcggcctcccaaagtgctgggattacagatgtgagccaccgcatccagccccacaccctcatttataccaattacctgcccagtaactgtggacttttgcttcctcacccctgctctgatctggaaggagagggattatgttatagcttgtcagcacagtcccaagttcaatatttctgcggcaaaaacttccttcaaaaaataaatgtacttcattgtattcaatgaattcaccttggaaatgcaccgcctcaacttgttcacatggcataaatgaaaggaattttatagtctcctaaatggcgtgtactgcaagacctcttgaacactttccagaggataggatatttaagtcatgcccttggcgttgcctatggcacctttcccttctgaaagtctggttcctgcccagtgacccttggccttgtgagccgagatgctgaccctgcataaagggccaaaggagggctgcggcttccttccctcactgaagagcccttatttgaattcactgtgtggagccctagccctccattctcgacattccccaacctcccagccccttccaagcaggactaggtgccctgcattccacccaaggtgggattggccttccttaggctggctacttgtcaccatcaccgacatcactgttgcctgcaaggacaccacgtggccattttccttcaactgagggctcaaaactcctggacaagttgctggctcctgagaccagtatttcctggagctgtgcctcagtgaaggggcccagcctgaggaaccctggctcttttctttaaagcccaggccccacttacataaaacatttcagggtcactggaaacagtgaagtgccatttgttgaagcctactgcatgccagcccactgctcatccacgtggtctgccatgcctacgaggaaggccagcgcatgcaggactggtctctaatgctgtggtcattgcacagaagggaaaggtctcaaggaagagtcaactgggacaagcacaagcccaccggacatggccttggtaaaggttagcagactggtgtgtgtggatctgcagtgcttcactggaaataatttattcattgcagatactttttaggtggcattttattcatttcctgtgctttaaataaacaaatgtaccaaaaaacaagtatcaagctgtttaagtgcttcggctacttgtcccctggttcagtagaggccccggtttcccagttgttgactgtgacaggctcagcatgggctcagcagatgctgtcttaatttgtggatgatacagaaagccaggctttgggatacaagttctttcctcttcatttgatgccgtgcactgtgtgaagcagatgtttttgtccggaaataaaaataatagtcttggagtctcgccaaaaaaaaaaccagcagcgaagacgagg

SEQ ID NO: 288408 - DNA, 5762 bp, Homo sapiens
agggcggggctcgggccggtccgcccgcgcgcaggtgagtgagccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcaataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaaaccataagctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccgacaagaggcctccaggcagggtctgacggtgtcctttataccttatttcaaagaggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctctaactgcagccccacgagcggcaagcagctagacctgctcttctcggtgacacttaccccaaggactgtggacttgactgtcatcctcatcgcagcggtgggaggtggagtcttactgctgtctgccctcgggctcatcatttgctgtgtgaaaaagaagaaaaagaagacaaacaagggccccgctgtgggtatctacaatggcaacatcaatactgagatgccgaggcagccaaaaaagtttcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataacttgatccattccagacgctttgctgagtttcataaagcagggcactgagacacccgtccgtgttcctaaccagaaatcctaaagaagaggaattatacagaaggaacagcaggaggttttcctggacaccgccaacttcacattgctcagtggactcattctaagggcaagacattgaaaatgatgaattccaatctggatacagtcatgacagctcatgtgctcctcaacttaggctgtgcggttagccagcctgtaatgagaggagagaggcctgagtcacctagcatagggttgcagcaagccctggattcagagtgttaaacagaggcttgccctcttcaggacaacagttccaattccaaggagcctacctgaggtccctactctcactggggtccccaggatgaaaacgacaatgtgcctttttattattatttatttggtggtcctgtgttatttaagagatcaaatgtataaccacctagctcttttcacctgacttagtaataactcatactaactggtttggatgcctgggttgtgacttctactgaccgctagataaacgtgtgcctgtcccccaggtggtgggaataatttacaatctgtccaaccagaaaagaatgtgtgtgtttgagcagcattgacacatatctgctttgataagagacttcctgattctctaggtcggttcgtggttatcccattgtggaaattcatcttgaatcccattgtcctatagtcctagcaataagagaaatttcctcaagtttccatgtgcggttctcctagctgcagcaatactttgacatttaaagagaaatttagagaatattctcatcctctaaaaatgtttaaatatataccaaacagtggccccctgcattagttttctgttgccactgcaacccattacttggtagcttaaaaacaacacattagcttatagtcctggggatcagaattccaaaatggatgtccctgaatgaaaatcaaggtgtcagcagagctgtgctccttctgaaggctctagggagaagccggttccttgccatttcaagcttctagaggctggctgcattcccaggctccagtggctggtcaagcttttctcacatggcatcactgtgacactggccctcccacttccctctttgacttacaaagcccaccaggaagatccaggataatctctccatctaaagatccttcatcatcctggaagagccttttgccatgcaagacaacatagccacaggtggggattaggaccaggacatctttggggtgctgttattctgcctaccacaccttcctgccactgactcccacaggagaggctacaaaatgatctggcgcacagggatgttttgtttagcttgcggactctaacacttaaaaaaaaccccagatcagaagatctggccatgctggggctcacattctcacctagcaacaactggctggagctgggcaccagctctgcctttagaaggggtgtccacttcaccaggtcaccacagcccacactacgccctatcacttcccacaatgaggctgagtgtttgtttctactgatcaatgcccctgcaggttgcatttattgtaatgaaaaagaaagactgggattaatctctaatcaggtgagtagaccatgagaccaatgtgtgctcacattaccctttttcttttttttctttttctttttctttttttttttaatgtgagacaggatctcattctgttgcctaggctggagtgcagtggcgcaatctcggctcactgcaacctctgcctcctgggctcaagcaattctcccacctcagcctcccaaatagctgggatcactggcacaaaccaccatgcccagctaattttgtattttttgtagagacagggtttcaccatgttgcccaggctggtctcaacctcctgggctcaagcaatcctcctgcctcggcctcccaaagtgctgggattacagatgtgagccaccgcatccagccccacaccctcatttataccaattacctgcccagtaactgtggacttttgcttcctcacccctgctctgatctggaaggagagggattatgttatagcttgtcagcacagtcccaagttcaatatttctgcggcaaaaacttccttcaaaaaataaatgtacttcattgtattcaatgaattcaccttggaaatgcaccgcctcaacttgttcacatggcataaatgaaaggaattttatagtctcctaaatggcgtgtactgcaagacctcttgaacactttccagaggataggatatttaagtcatgcccttggcgttgcctatggcacctttcccttctgaaagtctggttcctgcccagtgacccttggccttgtgagccgagatgctgaccctgcataaagggccaaaggagggctgcggcttccttccctcactgaagagcccttatttgaattcactgtgtggagccctagccctccattctcgacattccccaacctcccagccccttccaagcaggactaggtgccctgcattccacccaaggtgggattggccttccttaggctggctacttgtcaccatcaccgacatcactgttgcctgcaaggacaccacgtggccattttccttcaactgagggctcaaaactcctggacaagttgctggctcctgagaccagtatttcctggagctgtgcctcagtgaaggggcccagcctgaggaaccctggctcttttctttaaagcccaggccccacttacataaaacatttcagggtcactggaaacagtgaagtgccatttgttgaagcctactgcatgccagcccactgctcatccacgtggtctgccatgcctacgaggaaggccagcgcatgcaggactggtctctaatgctgtggtcattgcacagaagggaaaggtctcaaggaagagtcaactgggacaagcacaagcccaccggacatggccttggtaaaggttagcagactggtgtgtgtggatctgcagtgcttcactggaaataatttattcattgcagatactttttaggtggcattttattcatttcctgtgctttaaataaacaaatgtacca

SEQ ID NO: 288409 - DNA, 5737 bp, Homo sapiens
agggcggggctcgggccggtccgcccgcgcgcaggtgagtgagccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcaataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaaaccataagctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccgacaagaggcctccaggcagggtctgacggtgtcctttataccttatttcaaagaggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctctaactgcagccccacgagcggcaagcagctagacctgctcttctcggtgacacttaccccaaggactgtggacttgactgtcatcctcatcgcagcggtgggaggtggagtcttactgctgtctgccctcgggctcatcatttgctgtgtgaaaaagaagaaaaagaagacaaacaagggccccgctgtgggtatctacaatggcaacatcaatactgagatgccgaggcagccaaaaaagtttcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataacttgatccattccagacgctttgctgagtttcataaagcagggcactgagacacccgtccgtgttcctaaccagaaatcctaaagaagaggaattatacagaaggaacagcaggaggttttcctggacaccgccaacttcacattgctcagtggactcattctaagggcaagacattgaaaatgatgaattccaatctggatacagtcatgacagctcatgtgctcctcaacttaggctgtgcggttagccagcctgtaatgagaggagagaggcctgagtcacctagcatagggttgcagcaagccctggattcagagtgttaaacagaggcttgccctcttcaggacaacagttccaattccaaggagcctacctgaggtccctactctcactggggtccccaggatgaaaacgacaatgtgcctttttattattatttatttggtggtcctgtgttatttaagagatcaaatgtataaccacctagctcttttcacctgacttagtaataactcatactaactggtttggatgcctgggttgtgacttctactgaccgctagataaacgtgtgcctgtcccccaggtggtgggaataatttacaatctgtccaaccagaaaagaatgtgtgtgtttgagcagcattgacacatatctgctttgataagagacttcctgattctctaggtcggttcgtggttatcccattgtggaaattcatcttgaatcccattgtcctatagtcctagcaataagagaaatttcctcaagtttccatgtgcggttctcctagctgcagcaatactttgacatttaaagagaaatttagagaatattctcatcctctaaaaatgtttaaatatataccaaacagtggccccctgcattagttttctgttgccactgcaacccattacttggtagcttaaaaacaacacattagcttatagtcctggggatcagaattccaaaatggatgtccctgaatgaaaatcaaggtgtcagcagagctgtgctccttctgaaggctctagggagaagccggttccttgccatttcaagcttctagaggctggctgcattcccaggctccagtggctggtcaagcttttctcacatggcatcactgtgacactggccctcccacttccctctttgacttacaaagcccaccaggaagatccaggataatctctccatctaaagatccttcatcatcctggaagagccttttgccatgcaagacaacatagccacaggtggggattaggaccaggacatctttggggtgctgttattctgcctaccacaccttcctgccactgactcccacaggagaggctacaaaatgatctggcgcacagggatgttttgtttagcttgcggactctaacacttaaaaaaaaccccagatcagaagatctggccatgctggggctcacattctcacctagcaacaactggctggagctgggcaccagctctgcctttagaaggggtgtccacttcaccaggtcaccacagcccacactacgccctatcacttcccacctcagcctcccaaatagctgggatcactggcacaaaccaccatgcccagctaattttgtattttttgtagagacagggtttcaccatgttgcccaggctggtctcaacctcctgggctcaagcaatcctcctgcctcggcctcccaaagtgctgggattacagatgtgagccaccgcatccagccccacaccctcatttataccaattacctgcccagtaactgtggacttttgcttcctcacccctgctctgatctggaaggagagggattatgttatagcttgtcagcacagtcccaagttcaatatttctgcggcaaaaacttccttcaaaaaataaatgtacttcattgtattcaatgaattcaccttggaaatgcaccgcctcaacttgttcacatggcataaatgaaaggaattttatagtctcctaaatggcgtgtactgcaagacctcttgaacactttccagaggataggatatttaagtcatgcccttggcgttgcctatggcacctttcccttctgaaagtctggttcctgcccagtgacccttggccttgtgagccgagatgctgaccctgcataaagggccaaaggagggctgcggcttccttccctcactgaagagcccttatttgaattcactgtgtggagccctagccctccattctcgacattccccaacctcccagccccttccaagcaggactaggtgccctgcattccacccaaggtgggattggccttccttaggctggctacttgtcaccatcaccgacatcactgttgcctgcaaggacaccacgtggccattttccttcaactgagggctcaaaactcctggacaagttgctggctcctgagaccagtatttcctggagctgtgcctcagtgaaggggcccagcctgaggaaccctggctcttttctttaaagcccaggccccacttacataaaacatttcagggtcactggaaacagtgaagtgccatttgttgaagcctactgcatgccagcccactgctcatccacgtggtctgccatgcctacgaggaaggccagcgcatgcaggactggtctctaatgctgtggtcattgcacagaagggaaaggtctcaaggaagagtcaactgggacaagcacaagcccaccggacatggccttggtaaaggttagcagactggtgtgtgtggatctgcagtgcttcactggaaataatttattcattgcagatactttttaggtggcattttattcatttcctgtgctttaaataaacaaatgtaccaaaaaacaagtatcaagctgtttaagtgcttcggctacttgtcccctggttcagtagaggccccggtttcccagttgttgactgtgacaggctcagcatgggctcagcagatgctgtcttaatttgtggatgatacagaaagccaggctttgggatacaagttctttcctcttcatttgatgccgtgcactgtgtgaagcagatgtttttgtccggaaataaaaataatagtcttggagtctcgcca

SEQ ID NO: 288410 - DNA, 5174 bp, Homo sapiens
caacagccacctccttgctgggctaccatgacttctgatgtgtgctcttagttcaaatgcaggaactaaggccacaagaggcaaagtagcctgcccaagaacaccctattaggaagtggcagagccagaagacgaactaacatctccccaacgccactcacagctccaaccactgcccagaactgcctcctgagcaacacgtctgggtggagtgaaacctgtgccctgccccatgacacttagcatctaagacacagatacacagaagaaaaacttaagcaaaaaaggagaggaaatttcaaccctgagtactacccagaagtttgtttgccagcttagtaaacagtaagaatgtttactaagagagcagagggaccgctagaaaaggaacacagaggagccagaagcagagggcagggtgggagaagagagaccgaagggaaacacagggcagcatgcagacacccaacctcaggctgacgggagagctggggagggtgcacttctggtctcctttgtgcatggctagcatgccccacttcttccaggctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccgacaagaggcctccaggcagggtctgacggtgtcctttataccttatttcaaagaggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctctaactgcagccccacgagcggcaagcagctagacctgctcttctcggtgacacttaccccaaggactgtggacttgactgtcatcctcatcgcagcggtgggaggtggagtcttactgctgtctgccctcgggctcatcatttgctgtgtgaaaaagaagaaaaagaagacaaacaagggccccgctgtgggtatctacaatggcaacatcaatactgagatgccgaggcagccaaaaaagtttcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataacttgatccattccagacgctttgctgagtttcataaagcagggcactgagacacccgtccgtgttcctaaccagaaatcctaaagaagaggaattatacagaaggaacagcaggaggttttcctggacaccgccaacttcacattgctcagtggactcattctaagggcaagacattgaaaatgatgaattccaatctggatacagtcatgacagctcatgtgctcctcaacttaggctgtgcggttagccagcctgtaatgagaggagagaggcctgagtcacctagcatagggttgcagcaagccctggattcagagtgttaaacagaggcttgccctcttcaggacaacagttccaattccaaggagcctacctgaggtccctactctcactggggtccccaggatgaaaacgacaatgtgcctttttattattatttatttggtggtcctgtgttatttaagagatcaaatgtataaccacctagctcttttcacctgacttagtaataactcatactaactggtttggatgcctgggttgtgacttctactgaccgctagataaacgtgtgcctgtcccccaggtggtgggaataatttacaatctgtccaaccagaaaagaatgtgtgtgtttgagcagcattgacacatatctgctttgataagagacttcctgattctctaggtcggttcgtggttatcccattgtggaaattcatcttgaatcccattgtcctatagtcctagcaataagagaaatttcctcaagtttccatgtgcggttctcctagctgcagcaatactttgacatttaaagagaaatttagagaatattctcatcctctaaaaatgtttaaatatataccaaacagtggccccctgcattagttttctgttgccactgcaacccattacttggtagcttaaaaacaacacattagcttatagtcctggggatcagaattccaaaatggatgtccctgaatgaaaatcaaggtgtcagcagagctgtgctccttctgaaggctctagggagaagccggttccttgccatttcaagcttctagaggctggctgcattcccaggctccagtggctggtcaagcttttctcacatggcatcactgtgacactggccctcccacttccctctttgacttacaaagcccaccaggaagatccaggataatctctccatctaaagatccttcatcatcctggaagagccttttgccatgcaagacaacatagccacaggtggggattaggaccaggacatctttggggtgctgttattctgcctaccacaccttcctgccactgactcccacaggagaggctacaaaatgatctggcgcacagggatgttttgtttagcttgcggactctaacacttaaaaaaaaccccagatcagaagatctggccatgctggggctcacattctcacctagcaacaactggctggagctgggcaccagctctgcctttagaaggggtgtccacttcaccaggtcaccacagcccacactacgccctatcacttcccacaatgaggctgagtgtttgtttctactgatcaatgcccctgcaggttgcatttattgtaatgaaaaagaaagactgggattaatctctaatcaggtgagtagaccatgagaccaatgtgtgctcacattaccctttttcttttttttctttttctttttctttttttttttaatgtgagacaggatctcattctgttgcctaggctggagtgcagtggcgcaatctcggctcactgcaacctctgcctcctgggctcaagcaattctcccacctcagcctcccaaatagctgggatcactggcacaaaccaccatgcccagctaattttgtattttttgtagagacagggtttcaccatgttgcccaggctggtctcaacctcctgggctcaagcaatcctcctgcctcggcctcccaaagtgctgggattacagatgtgagccaccgcatccagccccacaccctcatttataccaattacctgcccagtaactgtggacttttgcttcctcacccctgctctgatctggaaggagagggattatgttatagcttgtcagcacagtcccaagttcaatatttctgcggcaaaaacttccttcaaaaaataaatgtacttcattgtattcaatgaattcaccttggaaatgcaccgcctcaacttgttcacatggcataaatgaaaggaattttatagtctcctaaatggcgtgtactgcaagacctcttgaacactttccagaggataggatatttaagtcatgcccttggcgttgcctatggcacctttcccttctgaaagtctggttcctgcccagtgacccttggccttgtgagccgagatgctgaccctgcataaagggccaaaggagggctgcggcttccttccctcactgaagagcccttatttgaattcactgtgtggagccctagccctccattctcgacattccccaacctcccagccccttccaagcaggactaggtgccctgcattccacccaaggtgggattggccttccttaggctggctacttgtcaccatcaccgacatcactgttgcctgcaaggacaccacgtggccattttccttcaactgagggctcaaaactcctggacaagttgctggctcctgagaccagtatttcctggagctgtgcctcagtgaaggggcccagcctgaggaaccctggctcttttctttaaagcccaggccccacttacataaaacatttcagggtcactggaaacagtgaagtgccatttgttgaagcctactgcatgccagcccactgctcatccacgtggtctgccatgcctacgaggaaggccagcgcatgcaggactggtctctaatgctgtggtcattgcacagaagggaaaggtctcaaggaagagtcaactgggacaagcacaagcccaccggacatggccttggtaaaggttagcagactggtgtgtgtggatctgcagtgcttcactggaaataatttattcattgcagatactttttaggtggcattttattcatttcctgtgctttaaataaacaaatgtaccaaaaaacaagtatcaagctgtttaagtgcttcggctacttgtcccctggttcagtagaggccccggtttcccagttgttgactgtgacaggctcagcatgggctcagcagatgctgtcttaatttgtggatgatacagaaagccaggctttgggatacaagttctttcctcttcatttgatgccgtgcactgtgtgaagcagatgtttttgtccggaaataaaaataatagtcttggagtctcgcca

SEQ ID NO: 288411 - DNA, 1743 bp, Homo sapiens
agggcggggctcgggccggtccgcccgcgcgcaggtgagtgagccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcaataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaaaccataagtacgcccctgaatcagtgcatttgtccctggccatggatagctcttctctccccgccttgccttagtggggttccctgggtaggttgtaaatcatatcaaaaaggcccatctggccgggcacgatggctcacgcctgtaatcccagcactttgggaggccaaggctggtggatcacttgaggtcaggagttcaagaccagcctggccaacgtggtaaaaccccatctttactaaaaatacaaaaattagctgggcatggtggcaggcgcctataatctcagctgctcagaaggctgaagcaggagaatggcctgaacctgggaggcggaggttgcagtgagccgagattgcaccacgcac

SEQ ID NO: 288412 - DNA, 3233 bp, Homo sapiens
agggcggggctcgggccggtccgcccgcgcgcaggtgagtgagccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcaataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaaaccataagctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccgacaagaggcctccaggcagggtctgacggtgtcctttataccttatttcaaagaggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctctaactgcagccccacgagcggcaagcagctagacctgctcttctcggtgacacttaccccaaggactgtggacttgactgtcatcctcatcgcagcggtgggaggtggagtcttactgctgtctgccctcgggctcatcatttgctgtgtgaaaaagaagaaaaagaagacaaacaagggccccgctgtgggtatctacaatggcaacatcaatactgagatgccgaggcagccaaaaaagtttcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataacttgatccattccagacgctttgctgagtttcataaagcagggcactgagacacccgtccgtgttcctaaccagaaatcctaaagaagaggaattatacagaaggaacagcaggaggttttcctggacaccgccaacttcacattgctcagtggactcattctaagggcaagacattgaaaatgatgaattccaatctggatacagtcatgacagctcatgtgctcctcaacttaggctgtgcggttagccagcctgtaatgagaggagagaggcctgagtcacctagcatagggttgcagcaagccctggattcagagtgttaaacagaggcttgccctcttcaggacaacagttccaattccaaggagcctacctgaggtccctactctcactggggtccccaggatgaaaacgacaatgtgcctttttattattatttatttggtggtcctgtgttatttaagagatcaaatgtataaccacctagctcttttcacctgacttagtaataactcatactaactggtttggatgcctgggttgtgacttctactgaccgctagataaacgtgtgcctgtccccc

SEQ ID NO: 288413 - DNA, 6008 bp, Homo sapiens
agggcggggctcgggccggtccgcccgcgcgcaggtgagtgagccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcaataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaaaccataagctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccgacaagaggcctccaggcagggtctgacggtgtcctttataccttatttcaaagaggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctctaactgcagccccacgagcggcaagcagctagacctgctcttctcggtgacacttaccccaaggactgtggacttgactgtcatcctcatcgcagcggtgggaggtggagtcttactgctgtctgccctcgggctcatcatttgctgtgtgaaaaagaagaaaaagaagacaaacaagggccccgctgtgggtatctacaatggcaacatcaatactgagatgccgaggcagccaaaaaagtttcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataacttgatccattccagacgctttgctgagtttcataaagcagggcactgagacacccgtccgtgttcctaaccagaaatcctaaagaagaggaattatacagaaggaacagcaggaggttttcctggacaccgccaacttcacattgctcagtggactcattctaagggcaagacattgaaaatgatgaattccaatctggatacagtcatgacagctcatgtgctcctcaacttaggctgtgcggttagccagcctgtaatgagaggagagaggcctgagtcacctagcatagggttgcagcaagccctggattcagagtgttaaacagaggcttgccctcttcaggacaacagttccaattccaaggagcctacctgaggtccctactctcactggggtccccaggatgaaaacgacaatgtgcctttttattattatttatttggtggtcctgtgttatttaagagatcaaatgtataaccacctagctcttttcacctgacttagtaataactcatactaactggtttggatgcctgggttgtgacttctactgaccgctagataaacgtgtgcctgtcccccaggtggtgggaataatttacaatctgtccaaccagaaaagaatgtgtgtgtttgagcagcattgacacatatctgctttgataagagacttcctgattctctaggtcggttcgtggttatcccattgtggaaattcatcttgaatcccattgtcctatagtcctagcaataagagaaatttcctcaagtttccatgtgcggttctcctagctgcagcaatactttgacatttaaagagaaatttagagaatattctcatcctctaaaaatgtttaaatatataccaaacagtggccccctgcattagttttctgttgccactgcaacccattacttggtagcttaaaaacaacacattagcttatagtcctggggatcagaattccaaaatggatgtccctgaatgaaaatcaaggtgtcagcagagctgtgctccttctgaaggctctagggagaagccggttccttgccatttcaagcttctagaggctggctgcattcccaggctccagtggctggtcaagcttttctcacatggcatcactgtgacactggccctcccacttccctctttgacttacaaagcccaccaggaagatccaggataatctctccatctaaagatccttcatcatcctggaagagccttttgccatgcaagacaacatagccacaggtggggattaggaccaggacatctttggggtgctgttattctgcctaccacaccttcctgccactgactcccacaggagaggctacaaaatgatctggcgcacagggatgttttgtttagcttgcggactctaacacttaaaaaaaaccccagatcagaagatctggccatgctggggctcacattctcacctagcaacaactggctggagctgggcaccagctctgcctttagaaggggtgtccacttcaccaggtcaccacagcccacactacgccctatcacttcccacaatgaggctgagtgtttgtttctactgatcaatgcccctgcaggttgcatttattgtaatgaaaaagaaagactgggattaatctctaatcaggtgagtagaccatgagaccaatgtgtgctcacattaccctttttcttttttttctttttctttttctttttttttttaatgtgagacaggatctcattctgttgcctaggctggagtgcagtggcgcaatctcggctcactgcaacctctgcctcctgggctcaagcaattctcccacctcagcctcccaaatagctgggatcactggcacaaaccaccatgcccagctaattttgtattttttgtagagacagggtttcaccatgttgcccaggctggtctcaacctcctgggctcaagcaatcctcctgcctcggcctcccaaagtgctgggattacagatgtgagccaccgcatccagccccacaccctcatttataccaattacctgcccagtaactgtggacttttgcttcctcacccctgctctgatctggaaggagagggattatgttatagcttgtcagcacagtcccaagttcaatatttctgcggcaaaaacttccttcaaaaaataaatgtacttcattgtattcaatgaattcaccttggaaatgcaccgcctcaacttgttcacatggcataaatgaaaggaattttatagtctcctaaatggcgtgtactgcaagacctcttgaacactttccagaggataggatatttaagtcatgcccttggcgttgcctatggcacctttcccttctgaaagtctggttcctgcccagtgacccttggccttgtgagccgagatgctgaccctgcataaagggccaaaggagggctgcggcttccttccctcactgaagagcccttatttgaattcactgtgtggagccctagccctccattctcgacattccccaacctcccagccccttccaagcaggactaggtgccctgcattccacccaaggtgggattggccttccttaggctggctacttgtcaccatcaccgacatcactgttgcctgcaaggacaccacgtggccattttccttcaactgagggctcaaaactcctggacaagttgctggctcctgagaccagtatttcctggagctgtgcctcagtgaaggggcccagcctgaggaaccctggctcttttctttaaagcccaggccccacttacataaaacatttcagggtcactggaaacagtgaagtgccatttgttgaagcctactgcatgccagcccactgctcatccacgtggtctgccatgcctacgaggaaggccagcgcatgcaggactggtctctaatgctgtggtcattgcacagaagggaaaggtctcaaggaagagtcaactgggacaagcacaagcccaccggacatggccttggtaaaggttagcagactggtgtgtgtggatctgcagtgcttcactggaaataatttattcattgcagatactttttaggtggcattttattcatttcctgtgctttaaataaacaaatgtaccaaaaaacaagtatcaagctgtttaagtgcttcggctacttgtcccctggttcagtagaggccccggtttcccagttgttgactgtgacaggctcagcatgggctcagcagatgctgtcttaatttgtggatgatacagaaagccaggctttgggatacaagttctttcctcttcatttgatgccgtgcactgtgtgaagcagatgtttttgtccggaaataaaaataatagtcttggagtctcgcca

SEQ ID NO: 288414 - DNA, 5911 bp, Homo sapiens
agggcggggctcgggccggtccgcccgcgcgcaggtgagtgagccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcaataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaaaccataagctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccgacaagaggcctccaggcagggtctgacggtgtcctttataccttatttcaaagaggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctctaactgcagccccacgagcggcaagcagctagacctgctcttctcggtgacacttaccccaaggactgtggacttgactgtcatcctcatcgcagcggtgggaggtggagtcttactgctgtctgccctcgggctcatcatttgctgtgtgaaaaagaagaaaaagaagacaaacaagggccccgctgtgggtatctacaatggcaacatcaatactgagatgccgaggcagccaaaaaagtttcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataacttgatccattccagacgctttgctgagtttcataaagcagggcactgagacacccgtccgtgttcctaaccagaaatcctaaagaagaggaattatacagaaggaacagcaggaggttttcctggacaccgccaacttcacattgctcagtggactcattctaagggcaagacattgaaaatgatgaattccaatctggatacagtcatgacagctcatgtgctcctcaacttaggctgtgcggttagccagcctgtaatgagaggagagaggcctgagtcacctagcatagggttgcagcaagccctggattcagagtgttaaacagaggcttgccctcttcaggacaacagttccaattccaaggagcctacctgaggtccctactctcactggggtccccaggatgaaaacgacaatgtgcctttttattattatttatttggtggtcctgtgttatttaagagatcaaatgtataaccacctagctcttttcacctgacttagtaataactcatactaactggtttggatgcctgggttgtgacttctactgaccgctagataaacgtgtgcctgtcccccaggtggtgggaataatttacaatctgtccaaccagaaaagaatgtgtgtgtttgagcagcattgacacatatctgctttgataagagacttcctgattctctaggtcggttcgtggttatcccattgtggaaattcatcttgaatcccattgtcctatagtcctagcaataagagaaatttcctcaagtttccatgtgcggttctcctagctgcagcaatactttgacatttaaagagaaatttagagaatattctcatcctctaaaaatgtttaaatatataccaaacagtggccccctgcattagttttctgttgccactgcaacccattacttggtagcttaaaaacaacacattagcttatagtcctggggatcagaattccaaaatggatgtccctgaatgaaaatcaaggtgtcagcagagctgtgctccttctgaaggctctagggagaagccggttccttgccatttcaagcttctagaggctggctgcattcccaggctccagtggctggtcaagcttttctcacatggcatcactgtgacactggccctcccacttccctctttgacttacaaagcccaccaggaagatccaggataatctctccatctaaagatccttcatcatcctggaagagccttttgccatgcaagacaacatagccacaggtggggattaggaccaggacatctttggggtgctgttattctgcctaccacaccttcctgccactgactcccacaggagaggctacaaaatgatctggcgcacagggatgttttgtttagcttgcggactctaacacttaaaaaaaaccccagatcagaagatctggccatgctggggctcacattctcacctagcaacaactggctggagctgggcaccagctctgcctttagaaggggtgtccacttcaccaggtcaccacagcccacactacgccctatcacttcccacaatgaggctgagtgtttgtttctactgatcaatgcccctgcaggttgcatttattgtaatgaaaaagaaagactgggattaatctctaatcaggtgagtagaccatgagaccaatgtgtgctcacattaccctttttcttttttttctttttctttttctttttttttttaatgtgagacaggatctcattctgttgcctaggctggagtgcagtggcgcaatctcggctcactgcaacctctgcctcctgggctcaagcaattctcccacctcagcctcccaaatagctgggatcactggcacaaaccaccatgcccagctaattttgtattttttgtagagacagggtttcaccatgttgcccaggctggtctcaacctcctgggctcaagcaatcctcctgcctcggcctcccaaagtgctgggattacagatgtgagccaccgcatccagccccacaccctcatttataccaattacctgcccagtaactgtggacttttgcttcctcacccctgctctgatctggaaggagagggattatgttatagcttgtcagcacagtcccaagttcaatatttctgcggcaaaaacttccttcaaaaaataaatgtacttcattgtattcaatgaattcaccttggaaatgcaccgcctcaacttgttcacatggcataaatgaaaggaattttatagtctcctaaatggcgtgtactgcaagacctcttgaacactttccagaggataggatatttaagtcatgcccttggcgttgcctatggcacctttccctcactgaagagcccttatttgaattcactgtgtggagccctagccctccattctcgacattccccaacctcccagccccttccaagcaggactaggtgccctgcattccacccaaggtgggattggccttccttaggctggctacttgtcaccatcaccgacatcactgttgcctgcaaggacaccacgtggccattttccttcaactgagggctcaaaactcctggacaagttgctggctcctgagaccagtatttcctggagctgtgcctcagtgaaggggcccagcctgaggaaccctggctcttttctttaaagcccaggccccacttacataaaacatttcagggtcactggaaacagtgaagtgccatttgttgaagcctactgcatgccagcccactgctcatccacgtggtctgccatgcctacgaggaaggccagcgcatgcaggactggtctctaatgctgtggtcattgcacagaagggaaaggtctcaaggaagagtcaactgggacaagcacaagcccaccggacatggccttggtaaaggttagcagactggtgtgtgtggatctgcagtgcttcactggaaataatttattcattgcagatactttttaggtggcattttattcatttcctgtgctttaaataaacaaatgtaccaaaaaacaagtatcaagctgtttaagtgcttcggctacttgtcccctggttcagtagaggccccggtttcccagttgttgactgtgacaggctcagcatgggctcagcagatgctgtcttaatttgtggatgatacagaaagccaggctttgggatacaagttctttcctcttcatttgatgccgtgcactgtgtgaagcagatgtttttgtccggaaataaaaataatagtcttggagtctcgcca

SEQ ID NO: 288415 - DNA, 5664 bp, Homo sapiens
agggcggggctcgggccggtccgcccgcgcgcaggtgagtgagccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcaataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaaaccataagctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccgacaagaggcctccaggcagggtctgacggtgtcctttataccttatttcaaagaggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctctaactgcagccccacgagcggcaagcagctagacctgctcttctcggtgacacttaccccaaggactgtggacttgactgtcatcctcatcgcagcggtgggaggtggagtcttactgctgtctgccctcgggctcatcatttgctgtgtgaaaaagaagaaaaagaagacaaacaagggccccgctgtgggtatctacaatggcaacatcaatactgagatgccgaggcagccaaaaaagtttcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataacttgatccattccagacgctttgctgagtttcataaagcagggcactgagacacccgtccgtgttcctaaccagaaatcctaaagaagaggaattatacagaaggaacagcaggaggttttcctggacaccgccaacttcacattgctcagtggactcattctaagggcaagacattgaaaatgatgaattccaatctggatacagtcatgacagctcatgtgctcctcaacttaggctgtgcggttagccagcctgtaatgagaggagagaggcctgagtcacctagcatagggttgcagcaagccctggattcagagtgttaaacagaggcttgccctcttcaggacaacagttccaattccaaggagcctacctgaggtccctactctcactggggtccccaggatgaaaacgacaatgtgcctttttattattatttatttggtggtcctgtgttatttaagagatcaaatgtataaccacctagctcttttcacctgacttagtaataactcatactaactggtttggatgcctgggttgtgacttctactgaccgctagataaacgtgtgcctgtcccccaggtggtgggaataatttacaatctgtccaaccagaaaagaatgtgtgtgtttgagcagcattgacacatatctgctttgataagagacttcctgattctctaggtcggttcgtggttatcccattgtggaaattcatcttgaatcccattgtcctatagtcctagcaataagagaaatttcctcaagtttccatgtgcggttctcctagctgcagcaatactttgacatttaaagagaaatttagagaatattctcatcctctaaaaatgtttaaatatataccaaacagtggccccctgcattagttttctgttgccactgcaacccattacttggtagcttaaaaacaacacattagcttatagtcctggggatcagaattccaaaatggatgtccctgaatgaaaatcaaggtgtcagcagagctgtgctccttctgaaggctctagggagaagccggttccttgccatttcaagcttctagaggctggctgcattcccaggctccagtggctggtcaagcttttctcacatggcatcactgtgacactggccctcccacttccctctttgacttacaaagcccaccaggaagatccaggataatctctccatctaaagatccttcatcatcctggaagagccttttgccatgcaagacaacatagccacaggtggggattaggaccaggacatctttggggtgctgttattctgcctaccacaccttcctgccactgactcccacaggagaggctacaaaatgatctggcgcacagggatgttttgtttagcttgcggactctaacacttaaaaaaaaccccagatcagaagatctggccatgctggggctcacattctcacctagcaacaactggctggagctgggcaccagctctgcctttagaaggggtgtccacttcaccaggtcaccacagcccacactacgccctatcacttcccacaatgaggctgagtgtttgtttctactgatcaatgcccctgcaggttgcatttattgtaatgaaaaagaaagactgggattaatctctaatcaggtgagtagaccatgagaccaatgtgtgctcacattaccctttttcttttttttctttttctttttctttttttttttaatgtgagacaggatctcattctgttgcctaggctggagtgcagtggcgcaatctcggctcactgcaacctctgcctcctgggctcaagcaattctcccacctcagcctcccaaatagctgggatcactggcacaaaccaccatgcccagctaattttgtattttttgtagagacagggtttcaccatgttgcccaggctggtctcaacctcctgggctcaagcaatcctcctgcctcggcctcccaaagtgctgggattacagatgtgagccaccgcatccagccccacaccctcatttataccaattacctgcccagtaactgtggacttttgcttcctcacccctgctctgatctggaaggagagggattatgttatagcttgtcagcacagtcccaagttcaatatttctgcggcaaaaacttccttcaaaaaataaatgtacttcattgtattcaatgaattcaccttggaaatgcaccgcctcaacttgttcacatggcataaatgaaaggaattttatagtctcctaaatggcgtgtactgcaagacctcttgaacactttccagaggataggatatttaagtcatgcccttggcgttgcctatggcacctttcccttctgaaagtctggttcctgcccagtgacccttggccttgtgagccgagatgctgaccctgcataaagggccaaaggagggctgcggcttccttccctcactgaagagcccttatttgaattcactgtgtggagccctagccctccattctcgacattccccaacctcccagccccttccaagcaggactaggtgccctgcattccacccaaggtgggattggccttccttaggctggctacttgtcaccatcaccgacatcactgttgcctgcaaggacaccacgtggccattttccttcaactgagggctcaaaactcctggacaagttgctggctcctgagaccagtatttcctggagctgtgcctcagtgaaggggcccagcctgaggaaccctggctcttttctttaaagcccaggccccacttacataaaacatttcagggtcactggaaacagtgaagtgccatttgttgaagcctactgcatgccagcccactgctcatccacgtggtctgccatgcctacgaggaaggccagcgcatgcaggactggtctctaatgctgtggtcattgcacagaagggaaaggtctcaggagccaccaacttgtccaggagttttgagcactcagttgaaggaaaatggccacgtggagattcggtgtgcg

SEQ ID NO: 288416 - DNA, 399 bp, Homo sapiens
ggtgatctagaggatcccagcgctcagcaatcctaattgggcccttttaatgtttagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgca

SEQ ID NO: 288417 - DNA, 502 bp, Homo sapiens
agcgggtcgtccgggcaacccgggagcgtttgtccacacaatttctgctccgactctgcggactactgcagtggagcttgactcttaatggtgagcaaggcaaatgaggcagacaggtggaggggcgaccactgattctgcttcaccagtgttaaataatgtaatcaagagccagtcatattttacagcgaagcgggtcggtttgggaaataactcataccttggggtgggtcggccctcttctcagcaatggctttccttacctggaccaggcggacaggtaggagtcccaaaccagtttctgcaaacgggagatggtcaaagctgtcacacggtatcctgatctcgaatgttgctaagcttgaaaattggtcccaacctagtaactttcagtagtgatagacgttcccactaaattttcttattgcaacttggcggaaatgttttagtacttctccagcagttaattaaaagctaatgcaatttactctgctttgaaaaa

SEQ ID NO: 288418 - DNA, 471 bp, Homo sapiens
tttgtaccctaaagttactagggatagatcaactgatgaaccaacaaccctcattgcagtatgaatttcagagtttttgatccaccctaaaggggctacgtgatgtttatcatccagccatttgaaatcctttttgaggttggtttctctctgaatgatcccctattgctcatcagtcagaaattacatagcctgggccgagcgcagtggctcacgcctggaatcccagcactttgggaggccaaggcgggcaatcacctgaggtcagcagttcgagaccagcctggccaacatggtgaagccctactaaaaatacaaaaattagccaggcgtggtggcacacacctgtaatcccagctactcaggaggctgaggcaaaagaatcgcttgaacctgggaaggggaggttgccatgagccgagatcgtaccactgcactccagcctgggcaacagagtgaaactctgtctca

SEQ ID NO: 288419 - DNA, 2365 bp, Homo sapiens
agcgggtcgtccgggcaacccgggagcgtttgtccacacaatttctgctccgactctgcggactactgcagtggagcttgactcttaatgtctggcagtaagaaaaagaaagtcaccaaagctgaacgattgaagctgctacaagaggaggaggagagacgactgaaagaggaagaggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtccacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaaggtgagggaacaccttactgaagaatgtactgagaatcctaattgggcccttttaatgtttagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgca

SEQ ID NO: 288420 - DNA, 2556 bp, Homo sapiens
agcgggtcgtccgggcaacccgggagcgtttgtccacacaatttctgctccgactctgcggactactgcagtggagcttgactcttaatggtgagcaaggcaaatgaggcagacaggtggaggggcgaccactgattctgcttcaccagtgttaaataatgtaatcaagagccagtcatattttacagcgaagcgggtcggtttgggaaataactcataccttggggtgggtcggccctcttctcagcaatggctttccttacctggaccaggcggacaggtctggcagtaagaaaaagaaagtcaccaaagctgaacgattgaagctgctacaagaggaggaggagagacgactgaaagaggaagaggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtccacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaaggtgagggaacaccttactgaagaatgtactgagaatcctaattgggcccttttaatgtttagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgca

SEQ ID NO: 288421 - DNA, 2539 bp, Homo sapiens
  misc_feature (219)..(219): n is a, c, g, or t
  misc_feature (338)..(338): n is a, c, g, or t
agcgggtcgtccgggcaacccgggagcgtttgtccacacaatttctgctccgactctgcggactactgcagtggagcttgactcttaatgtctggcagtaagaaaaagaaagtcaccaaagctgaacgattgaagctgctacaagaggaggaggagagacgactgaaagaggaagttactgtcttgaagaaaggagaactgacacttttctcatatctnccatgtaataaagactgtgacttctataaaagattccaccactacatcttgaaaatattaggagtaattttaagggcttaaaaatacagtgatctattcactgagaaaaaaattatttntggttctttagaggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtccacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaaggtgagggaacaccttactgaagaatgtactgagaatcctaattgggcccttttaatgtttagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgca

SEQ ID NO: 288422 - DNA, 1939 bp, Homo sapiens
agcgggtcgtccgggcaacccgggagcgtttgtccacacaatttctgctccgactctgcggactactgcagtggagcttgactcttaatgtctggcagtaagaaaaagaaagtcaccaaagctgaacgattgaagctgctacaagaggaggaggagagacgactgaaagaggaagaggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtccacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggcaagaatgaatctttccaaatttaatgtggcgtgcatttaaaatgttagcaattattaaatgttatataatttaatattatatacactgta

SEQ ID NO: 288423 - DNA, 537 bp, Homo sapiens
caaagcaatttttttggtgctttcatttatctttttttaatagggaaaaaatgaaactagtgtcactttcttcatcaattataaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggtgagttactcttgtagctgttatgtactatcgtatcagaggtaaaccattttgatggaatactagtttgtcaaaagcaatcagtggctgctgatttatatattgaaatataagtgtcttataatgaccttaaaaatgtaccttgagctatatttctaaatgaaatattagttgaataattaaataggcaataacatgtaaatagcaaggctcaaacttaaatttgtaccctaaag

SEQ ID NO: 288424 - DNA, 858 bp, Homo sapiens
  misc_feature (219)..(219): n is a, c, g, or t
  misc_feature (338)..(338): n is a, c, g, or t
agcgggtcgtccgggcaacccgggagcgtttgtccacacaatttctgctccgactctgcggactactgcagtggagcttgactcttaatgtctggcagtaagaaaaagaaagtcaccaaagctgaacgattgaagctgctacaagaggaggaggagagacgactgaaagaggaagttactgtcttgaagaaaggagaactgacacttttctcatatctnccatgtaataaagactgtgacttctataaaagattccaccactacatcttgaaaatattaggagtaattttaagggcttaaaaatacagtgatctattcactgagaaaaaaattatttntggttctttagaggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaagtaagtgtgatattttgcttatatattaag

SEQ ID NO: 288425 - DNA, 2420 bp, Homo sapiens
agcgggtcgtccgggcaacccgggagcgtttgtccacacaatttctgctccgactctgcggactactgcagtggagcttgactcttaatggtcccaaagcaaaaaaggaacactgtcatcacaaacaggcttcagtggccaaagatctggcagtaagaaaaagaaagtcaccaaagctgaacgattgaagctgctacaagaggaggaggagagacgactgaaagaggaagaggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtccacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaaggtgagggaacaccttactgaagaatgtactgagaatcctaattgggcccttttaatgtttagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgca

SEQ ID NO: 288426 - DNA, 2462 bp, Homo sapiens
agcgggtcgtccgggcaacccgggagcgtttgtccacacaatttctgctccgactctgcggactactgcagtggagcttgactcttaatggtgagcaaggcaaatgaggcagacaggtggaggggcgaccactgattctgcttcaccagtgttaaataatgtaatcaagagccagtcatattttacagcgaagcgggtcggtttgggaaataactcataccttggggtgggtcggccctcttctcagcaatggctttccttacctggaccaggcggacaggtctggcagtaagaaaaagaaagtcaccaaagctgaacgattgaagctgctacaagaggaggaggagagacgactgaaagaggagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtccacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaaggtgagggaacaccttactgaagaatgtactgagaatcctaattgggcccttttaatgtttagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgca

SEQ ID NO: 288427 - DNA, 1746 bp, Homo sapiens
agcgggtcgtccgggcaacccgggagcgtttgtccacacaatttctgctccgactctgcggactactgcagtggagcttgactcttaatggtgagcaaggcaaatgaggcagacaggtggaggggcgaccactgattctgcttcaccagtgttaaataatgtaatcaagagccagtcatattttacagcgaagcgggtcggtttgggaaataactcataccttggggtgggtcggccctcttctcagcaatggctttccttacctggaccaggcggacaggtctggcagtaagaaaaagaaagtcaccaaagctgaacgattgaagctgctacaagaggaggaggagagacgactgaaagaggaagaggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaagtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaaggtgagggaacaccttactgaagaatgtactgagaatcctaattgggcccttttaatgtttagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgca

SEQ ID NO: 288428 - DNA, 765 bp, Homo sapiens
tctccagcttctgagaactgtcaatgatggaaacgcttcaccaccaagggctaatactcgaagagaagtagtggctgacaaaacagttgacttgataagctgagatccaaatcttctaagcaatgttggtgttgcctgtagatacattaaaaataatttatttattttccttcacttctttaaaaaggtaagcactgtagttattatttcaaagttaacatttggagcccacatggaaatgaaggctgtgtttatcaaatgggaaatcccatttggaaaactactggtgcaacattatcttcttgttttttttttttttttttttttggttttgtttgtttgttttttgagacagggtctcactctgttgatcaggctgcagtgcaatagcatgaccatggctcactgcagcctcaacctcccaggcccaagtcatcatcccacctcagcctcctgaacagcttgggactacaggcacgtaccaccacacctagctaatttttaaaattttttgtacaaatggggcctgtgttgcctaggctggtcttggactcctgggctcaagcaatcctcccactttggcctcccaaagctctaggattagcagcatgagccaccatgcctggcccaacattatcttcctaatgtgggtatcacttatgctttagaaaaaaactcaagcaaaaatattacttatatttcatcatactgattacacaaaaaggtttaggataaaaaggacaaaatctataaaatcaatttacc

SEQ ID NO: 288429 - DNA, 876 bp, Homo sapiens
tctccagcttctgagaactgtcaatgatggaaacgcttcaccaccaagggctaatactcgaagagaagtagtggctgacaaaacagttgacttgataagctgagatccaaatcttctaagcaatgttggtgttgcctgtagatacattaaaaataatttatttattttccttcacttctttaaaaagatgccaaaaggaaaggccaagggaaagaaggtggctctggcccctgctgttgtgaagaagcaggaggacaagaaagtggtgaatcccctgtttgagaaaaggcctaagaattttggcactgagcaggacatccagcccaaaagagacctcaccagctttgtgaaatagccctgctctatcaggttgcagcggcagagagccatccctcaataagcggctgaaagtgcctcctgcgattaaccagttcacccaggccctggaccgccaaacagctactcagctgcttaagctggcccacaagtacagaccagagacaaagcaagagaagaagcagaggctgttgacctgggctgagaagaaagctgctggcaaaggggatgtccccagtaagagaccacctgtccttcgagcaggagttaacaccatcaacaccttggtggagaacaaagaaagctcagctggtggtgactgcacacgtggatcccatcgagttggttgtcttcttgcctgccctgtgtcataaaatgggggtcccttattgcattatcaaggggaagggaagactgggatgtctagtccacaggaagactaagctagtggaagctattaggaccaattacaatgacagatacgatgagatccaccgtcactggggcggcaatgtcctggctcccaagtctgtggctcgc

SEQ ID NO: 288430 - DNA, 518 bp, Homo sapiens
tagtagaggcagggtttctccatgttggtcaggctggtctcgaactcctgacctcaggtgatccacccacctcggcctcccaaagtgttcggattacaggtgtgagtcaccatgcttggccatgccggttgtttctgctgcttgctgtgtagaccgctgtgatgaccatcttcttattgaccctcctttgtctctggagccccgccacctgccttctacctggagccttccttccaggtccttcttcaacatcagctccaggatctgcaagatctttggatatggccgctgcagaaggaaggagaaccacttcctggagaagcaggagtgagccaggatctgccacacaagagagccgggaacccagggcatgggttaaggcgaggagcaggtccggagggaagatctgaggcaaagagagagcctgtcacctgtgctgccttgagatgctgacatctgaggatgccccagacagggcctgtggctgctttctgaaatagtgcagcaccttctctgct

SEQ ID NO: 288431 - DNA, 607 bp, Homo sapiens
attctttttctttctttttgaggtagagtctcgctctgtcacccaggctggagtgcactggtgagatttgggctcactggaacttccacctcccgggttcaagcgattctcgtgcctcagcctcccgagtagctgggattacaggcgtgagccaccgcgcctggcagtatcagattctttttaacaactgcctcctgctctgtcgcttggctgcatacaaatgtttttgggtgtttggattgtctctgattcttcgctcttagcaggcaagtcaacagtaaacatcactgcgcaggtgcctctgcagtaggttccctccaagtgggatgggcagggcagggtgagtgtgcgcttaattgacaggcttttacctctgaaaaagctgtgactggtggcattccccctgcggtgtgtgagggtgactgtcccccacagtgtcacaacactggctgtgaacattctttacaattttgccagtccagtgggttaaaaagaacaaaacaccatagaggtgaattctaactgaggagcttgaggatggccttgggagctgagacttgaagcataatggtggttaataaaagggagggggtcctttacgaaacag

SEQ ID NO: 288432 - DNA, 1998 bp, Homo sapiens
gggtcggcggccgcaggccggaggcgcgtcgggctggagccggtcacgatgccccgaaggaagcaaagccacccgcagcccgtgaaatgcgagggggtcaaagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtgaggggccgtgttgtggggcaggagggccgggtggggggcccctgctgcccccacggctactgtactcatgccgcctctgcaccttcgtgtcccactactcgagccacctgaagcggcacatgcagacacacagcggagagaagccgttccgctgtggccgctgcccctacgcctcagcccagctcgtcaacctgacacgacatacccgcacccacactggcgagaagccctaccgctgtccccactgcccctttgcctgcagcagcctgggcaacctgaggcggcatcagcgtacccacgcagggccccccactcctccctgcccgacctgtggcttccgctgctgtactccacgaccagcccggcctcccagtcccacagagcaggagggggcggtgccccggcgacctgaagatgctctgctccttccagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggccccagggccccagtgacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagcccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaagccaaaaatatgct

SEQ ID NO: 288433 - DNA, 2110 bp, Homo sapiens
tagagcttagaaaaaggtcttgggggctctctccctttcgtatttttactttcttgtctcaagaattaatttcattatggattcatttcagtctgtgatccactgtgagcccttgatccttgaccattgagggaaactagatacaggtcaattctaccatcactagattagtccagtgtaagaggtagacaattcatgttgaattttctggaattactgcaggggagaccttgattcctaggagggaactaaagggatcatcaaagctaagggtggagccaagcaagtggggagaccataagtgaaaaggggagagtttggagcctgatcctaccctatgctgatgtctcttcttatgtctatttcaccaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtgaggggccgtgttgtggggcaggagggccgggtggggggcccctgctgcccccacggctactgtactcatgccgcctctgcaccttcgtgtcccactactcgagccacctgaagcggcacatgcagacacacagcggagagaagccgttccgctgtggccgctgcccctacgcctcagcccagctcgtcaacctgacacgacatacccgcacccacactggcgagaagccctaccgctgtccccactgcccctttgcctgcagcagcctgggcaacctgaggcggcatcagcgtacccacgcagggccccccactcctccctgcccgacctgtggcttccgctgctgtactccacgaccagcccggcctcccagtcccacagagcaggagggggcggtgccccggcgacctgaagatgctctgctccttccagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggccccagggccccagtgacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagcccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaagccaaaaatatgct

SEQ ID NO: 288434 - DNA, 1745 bp, Homo sapiens
gggtcggcggccgcaggccggaggcgcgtcgggctggagccggtcacgatgccccgaaggaagcaaagccacccgcagcccgtgaaatgcgagggggtcaaagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtgtgcctgcagcagcctgggcaacctgaggcggcatcagcgtacccacgcagggccccccactcctccctgcccgacctgtggcttccgctgctgtactccacgaccagcccggcctcccagtcccacagagcaggagggggcggtgccccggcgacctgaagatgctctgctccttccagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggccccagggccccagtgacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagcccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaagccaaaaatatgct

SEQ ID NO: 288435 - DNA, 1557 bp, Homo sapiens
gggtcggcggccgcaggccggaggcgcgtcgggctggagccggtcacgatgccccgaaggaagcaaagccacccgcagcccgtgaaatgcgagggggtcaaagtggatactgaagactccctcgacgaaggacccggggccctggtattggagagtgatttgctactaggccagctcgtcaacctgacacgacatacccgcacccacactggcgagaagccctaccgctgtccccactgcccctttgcctgcagcagcctgggcaacctgaggcggcatcagcgtacccacgcagggccccccactcctccctgcccgacctgtggcttccgctgctgtactccacgaccagcccggcctcccagtcccacagagcaggagggggcggtgccccggcgacctgaagatgctctgctccttccagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggccccagggccccagtgacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagcccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaagccaaaaatatgct

SEQ ID NO: 288436 - DNA, 1412 bp, Homo sapiens
  misc_feature (78)..(78): n is a, c, g, or t
cccttcctctcagggcccgcggcgcccccatgcagcggccggccctgggcagcccccggcctggcccggcgtagggcnagcggccattcatggagccccctgcctgcagcagcctgggcaacctgaggcggcatcagcgtacccacgcagggccccccactcctccctgcccgacctgtggcttccgctgctgtactccacgaccagcccggcctcccagtcccacagagcaggagggggcggtgccccggcgacctgaagatgctctgctccttccagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggccccagggccccagtgacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagcccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaagccaaaaatatgct

SEQ ID NO: 288437 - DNA, 1834 bp, Homo sapiens
gggtcggcggccgcaggccggaggcgcgtcgggctggagccggtcacgatgccccgaaggaagcaaagccacccgcagcccgtgaaatgcgagggggtcaaagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtgaggggccgtgttgtggggcaggagggccgggtggggggcccctgctgcccccacggctactgtactcatgccgcctctgcaccttcgtgtcccactactcgagccacctgaagcggcacatgcagacacacagcggagagaagccgttccgctgtggccgctgcccctacgcctcagcccagctcgtcaacctgacacgacatacccgcacccacactggcgagaagccctaccgctgtccccactgcccctttgcctgcagcagcctgggcaacctgaggcggcatcagcgtacccacgcagggccccccactcctccctgcccgacctgtggcttccgctgctgtactccacgaccagcccggcctcccagtcccacagagcaggagggggcggtgccccggcgacctgaagatgctctgctccttccagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggaggacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagcccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaagccaaaaatatgct

SEQ ID NO: 288438 - DNA, 1553 bp, Homo sapiens
cggaagcggaagcgagtacggagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtgtgcctgcagcagcctgggcaacctgaggcggcatcagcgtacccacgcagggccccccactcctccctgcccgacctgtggcttccgctgctgtactccacgaccagcccggcctcccagtcccacagagcaggagggggcggtgccccggcgacctgaagatgctctgctccttccagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggaggcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagcccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaagccaaaaatatgct

SEQ ID NO: 288439 - DNA, 1810 bp, Homo sapiens
gggtcggcggccgcaggccggaggcgcgtcgggctggagccggtcacgatgccccgaaggaagcaaagccacccgcagcccgtgaaatgcgagggggtcaaagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtgaggggccgtgttgtggggcaggagggccgggtggggggcccctgctgcccccacggctactgtactcatgccgcctctgcaccttcgtgtcccactactcgagccacctgaagcggcacatgcagacacacagcggagagaagccgttccgctgtggccgctgcccctacgcctcagcccagctcgtcaacctgacacgacatacccgcacccacactggcgagaagccctaccgctgtccccactgcccctttgcctgcagcagcctgggcaacctgaggcggcatcagcgtacccacgcagggccccccactcctccctgcccgacctgtggcttccgctgctgtactccacgaccagcccggcctcccagtcccacagagcaggagggggcggtgccccggcgacctgaagatgctctgctccttccagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggccccagggccccagtgacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagcccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggacgcgaatcgtgccgttcggatcctctagatta

SEQ ID NO: 288440 - DNA, 1587 bp, Homo sapiens
gggtcggcggccgcaggccggaggcgcgtcgggctggagccggtcacgatgccccgaaggaagcaaagccacccgcagcccgtgaaatgcgagggggtcaaagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtgaggggccgtgttgtggggcaggagggccgggtggggggcccctgctgcccccacggctactgtactcatgccgcctctgcaccttcgtgtcccactactcgagccacctgaagcggcacatgcagacacacagcggagagaagccgttccgctgtggccgctgcccctacgcctcagcccagctcgtcaacctgacacgacatacccgcacccacactggcgagaagccctaccgctgtccccactgcccctttgcctgcagcagcctgggcaacctgaggcggcatcagcgtacccacgcagggccccccactcctccctgcccgacctgtggcttccgctgctgtactccacgaccagcccggcctcccagtcccacagagcaggagggggcggtgccccggcgacctgaagatgctctgctccttccagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggccccagggccccagtgacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagtatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaagccaaaaatatgct

SEQ ID NO: 288441 - DNA, 1169 bp, Homo sapiens
gggtcggcggccgcaggccggaggcgcgtcgggctggagccggtcacgatgccccgaaggaagcaaagccacccgcagcccgtgaaatgcgagggggtcaaagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtgaggggccgtgttgtggggcaggagggccgggtggggggcccctgctgcccccacggctactgtactcatgccgcctctgcaccttcgtgtcccactactcgagccacctgaagcggcacatgcagacacacagcggagagaagccgttccgctgtggccgctgcccctacgcctcagcccagctcgtcaacctgacacgacatacccgcacccacactggcgagaagccctaccgctgtccccactgcccctttgcctgcagcagcctgggcaacctgaggcggcatcagcgtacccacgcagggccccccactcctccctgcccgacctgtggcttccgctgctgtactccacgaccagcccggcctcccagtcccacagagcaggagggggcggtgccccggcgacctgaagatgctctgctccttccagattttatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaagccaaaaatatgct

SEQ ID NO: 288442 - DNA, 733 bp, Homo sapiens
gggtcggcggccgcaggccggaggcgcgtcgggctggagccggtcacgatgccccgaaggaagcaaagccacccgcagcccgtgaaatgcgagggggtcaaagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtgtatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaagccaaaaatatgct

SEQ ID NO: 288443 - DNA, 2107 bp, Homo sapiens
ggggccttgaggggagaggagcgggggtggggtcagtggagtgggctcaggtcagggtggagggggactcctgagggatgaagtgggcgatccagactcctagcttcccaccgaggcactaagggaatcagagtgggtcagcgagtacgggaagtgtggtccacgagggctggttcctgagggagaatccacaagccccctcccctcttcagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtgaggggccgtgttgtggggcaggagggccgggtggggggcccctgctgcccccacggctactgtactcatgccgcctctgcaccttcgtgtcccactactcgagccacctgaagcggcacatgcagacacacagcggagagaagccgttccgctgtggccgctgcccctacgcctcagcccagctcgtcaacctgacacgacatacccgcacccacactggcgagaagccctaccgctgtccccactgcccctttgcctgcagcagcctgggcaacctgaggcggcatcagcgtacccacgcagggccccccactcctccctgcccgacctgtggcttccgctgctgtactccacgaccagcccggcctcccagtcccacagagcaggagggggcggtgccccggcgacctgaagatgctctgctccttccagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggccccagggccccagtgacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagcccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaagccaaaaatatgct

SEQ ID NO: 288444 - DNA, 1562 bp, Homo sapiens
gggtcggcggccgcaggccggaggcgcgtcgggctggagccggtcacgatgccccgaaggaagcaaagccacccgcagcccgtgaaatgcgagggggtcaaagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtggagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggccccagggccccagtgacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagcccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaagccaaaaatatgct

SEQ ID NO: 288445 - DNA, 1357 bp, Homo sapiens
gagtgacttgaaggagcctacaggggatcgaggtcatggctcaaggaagtcatgtgcaaactgagtggaaacttagcgatacacaggcaaggtcccgcactcctcccgtggcccagacctgtgttctgtcgttgttgtaatctcaagatgagggcggtgctcgcattgccatggaggtgatgtggcggtgtcctgagtgactgaagatgctctgctccttccagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggccccagggccccagtgacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagcccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaagccaaaaatatgct

SEQ ID NO: 288446 - DNA, 1806 bp, Homo sapiens
gggtcggcggccgcaggccggaggcgcgtcgggctggagccggtcacgatgccccgaaggaagcaaagccacccgcagcccgtgaaatgcgagggggtcaaagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtgaggggccgtgttgtggggcaggagggccgggtggggggcccctgctgcccccacggctactgtactcatgccgcctctgcaccttcgtgtcccactactcgagccacctgaagcggcacatgcagacacacagcggagagaagccgttccgctgtggccgctgcccctacgcctcagcccagctcgtcaacctgacacgacatacccgcacccacactggcgagaagccctaccgctgtccccactgcccctttgcctgcagcagcctgggcaacctgaggcggcatcagcgtacccacgcagggccccccactcctccctgcccgacctgtggcttccgctgctgtactccacgaccagcccggcctcccagtcccacagagcaggagggggcggtgccccggcgacctgaagatgctctgctccttccagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggccccagggccccagtgacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagcccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggacacccggtataagcgggtcctcctgaat

SEQ ID NO: 288447 - DNA, 1830 bp, Homo sapiens
gggtcggcggccgcaggccggaggcgcgtcgggctggagccggtcacgatgccccgaaggaagcaaagccacccgcagcccgtgaaatgcgagggggtcaaagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtgaggggccgtgttgtggggcaggagggccgggtggggggcccctgctgcccccacggctactgtactcatgccgcctctgcaccttcgtgtcccactactcgagccacctgaagcggcacatgcagacacacagcggagagaagccgttccgctgtggccgctgcccctacgcctcagcccagctcgtcaacctgacacgacatacccgcacccacactggcgagaagccctaccgctgtccccactgcccctttgcctgcagcagcctgggcaacctgaggcggcatcagcgtacccacgcagggccccccactcctccctgcccgacctgtggcttccgctgctgtactccacgaccagcccggcctcccagtcccacagagcaggagggggcggtgccccggcgacctgaagatgctctgctccttccagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggccccagggccccagtgacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagcccttccgctgtgccacctgcgcctataccacgggccactgggacaactacaagcgccaccagaaggtgcattatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaagccaaaaatatgct

SEQ ID NO: 288448 - DNA, 1497 bp, Homo sapiens
gggtcggcggccgcaggccggaggcgcgtcgggctggagccggtcacgatgccccgaaggaagcaaagccacccgcagcccgtgaaatgcgagggggtcaaagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtgaggggccgtgttgtggggcaggagggccgggtggggggcccctgctgcccccacggctactgtactcatgccgcctctgcaccttcgtgtcccactactcgagccacctgaagcggcacatgcagacacacagcggagagaagccgttccgctgtggccgctgcccctacgcctcagcccagctcgtcaacctgacacgacatacccgcacccacactggcgagaagccctaccgctgtccccactgcccctttgcctgcagcagcctgggcaacctgaggcggcatcagcgtacccacgcagggccccccactcctccctgcccgacctgtggcttccgctgctgtactccacgaccagcccggcctcccagtcccacagagcaggagggggcggtgccccggcgacctgaagatgctctgctccttccagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggccccagggccccagtgacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcggcggcggcggcgggagcggcctgagctgggcgccggggccagggccgggggctgcccagggcccgcgccgctgcatgggggcggcccgcgggccctgagaggaagggcagacaggcgggccgagataggaggggcggggtcgggcggccgc

SEQ ID NO: 288449 - DNA, 300 bp, Homo sapiens
gggtcggcggccgcaggccggaggcgcgtcgggctggagccggtcacgatgccccgaaggaagcaaagccacccgcagcccgtgaaatgcgagggggtcaaagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggtgggttttcgggtcttggttaaggattagcggccgctgga

SEQ ID NO: 288450 - DNA, 809 bp, Homo sapiens
caacaacaactgggaagccttctcagctacacttcggggcactggtccaaccccacgcaaaatccctcgtttcccttagcgtgcagaaccacgggcacggtgatgatggtgacaagcgcagcagcacccagcagtcccagaagaaccttccacggtgtctgcaagccgagcagatcaagtccaattagagggaagcgtgtggccccagtttccgtaggagggtcggggctgctccagaggcagcaggatttgcaggaaggaagactgtacacagagaataaataacttggccaagccattcagctaggaagttgtagatcctaaattaagagttcaaggtcttaatggctactctatgcggcctctcatagtcttttcaagggttttggagaagaataaaagatcaggtatggcttctccctcccccagctctctattgttccctaaaggattattcattcgttcattcattcctacatcctcccatttattccagtcatccacagatgtttgagtggttacaatgtgccagcctcccttctaggtactggagataaagtgggacaagagaggtgaggtctggacccttggcactttcacgataaaatacacaggtaaacatttgcctttagggccccctgtgattacttccactcttgcagataagaggataaggcctcttcagcttgttcacagcagctggaaaagcaaagcctctctgtcagtagaggtaaaagattaagaatgcagagtccgatggggcattaccacatgattatgaattaatgcaattttccatcttttatttc

SEQ ID NO: 288451 - DNA, 441 bp, Homo sapiens
ctcaagacacgtggtctaggaagcaaaacactcttaactaggaataaaacttgccagcccctctctctcttaattttgcttaaaatgcaaagttaaaagccatcatgaaaccaggaaaggagtcatcatgtaggcataatcgtttattcaatcacaggcaaggagccgctttctgattctccagggcctcctctgtccccagtgttaccacagttccgctttcatagactgctgtagatacccagatccacttaatattgattgcaatttatatttacaggcttaatgccagacggtaagggagatgaggagggtaagggagatgagacggtaagggagatgaggacggtaagggagatgagacggtaagggagatgaggacggtaagggagatgagacgtaagggagatgaggaggtaaggagatgaacgtaaggaatga

SEQ ID NO: 288452 - DNA, 427 bp, Homo sapiens
tcttcctgtcactgatgtttgtgtcctgatgatctcctcccggggcaggtccctcacctttctgggaagtacaacttctgcatgttacaaattccaggaagaagcttagcccaggaaaaacaaagaccagttggacccagagatgcctgagttggagatgaactttggccaactttcctcatcaccatacttaaaatcctgtccaaggaggagcttattcaccattttctatacatgtgacatatgtagcagcataaccgacaactgggactgcgctgccttgactccacctctacatacaatgactcagctaaccagactaataaaagccatgtttgcaccattgctcagggaggcattgctttggggaattattcccagtgtcctccttacttatcgcaagtaataaaatccccctgggaaatcc

SEQ ID NO: 288453 - DNA, 710 bp, Homo sapiens
aaatgcaaaagcccaagatcaagaagtctgtaagtcatgaaagagtctccaaaatgaattttaaattgactggaaaagggatcacctttttctcatctgagagcaagaaatatgagagacccaaggatgatcgagaggaagagttcaacacgtgggtcaataatatgtacgtcttctttgtgaacacgctctttcatgcgtataaacgtgaagaagctatcaaggagaaaataagggcagacaggttacgtagcacagcacaggcccagcagcggaagatggaagatgacgaactggaagcaaggctgaacatcttcatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtgctgtaagatttcctgagcattacagttcttagcactgaactcgtcacagtgttttaacataccccttggcccactgcatctcaggtttcctacatggctggattacgggagttcgagaccagcctgggcaacatagtgagacccccccatctctgcaaaattaaaacatcagccgaccgtggtg

SEQ ID NO: 288454 - DNA, 525 bp, Homo sapiens
acctataacagtttctataagaatagtaaaaaggaataaatttaaagcatgaaaacaccaaggactctagttattacttaaatgatattgaatacaaatgtgatactaacgatgacaagggtaacaaattttatttcccaaatcacagaagctagcaaaaaatattctcaatgttcacctgtttttattttggctttagttaatatatttttgtgttacagactttacaaatcattaggagacaaaaaatttcccttattcagaaaaaacaggaagaggctggcattgcaattaatgaaggccaacagtataagttttaatgacttcaatcagaaaacaacaaggaagatgacattgtgggagacagctttagagacactacctctaatccttttaagatatataaacgactggtatatggcttcaaatcctcttatctttggcattaaaacgaaggaatttgactttcctttttagctgggaccataggcaggtgccaatctctatttactctaaataatgaca

SEQ ID NO: 288455 - DNA, 817 bp, Homo sapiens
acctataacagtttctataagaatagtaaaaaggaataaatttaaagcatgaaaacaccaaggactctagttattacttaaatgatattgaatacaaatgtgatactaacgatgacaagggtaacaaattttatttcccaaatcacagaagctagcaaaaaatattctcaatgttcacctgtttttattttggctttagttaatatatttttgtgttacagactttacaaatcattaggagacaaaaaatttcccttattcagaaaaaacaggaagaggctggcattgcaattaatgaaggccaacagtataagttttaatgacttcaatcagaaaacaacaaggaagatgacattgtgggagacagctttagagacactacctctaatccttttaagatatataaacgactggtatatggcttcaaatcctcttatctttggcattaaaacgaaggaatttgactttcctttttagctgggaccataggcaggtgccaccacaccaagctaatcttttaagtttttgttgatgcagagtatccttgtgttgtgctggctggttttgaactcctgggctaaaagtgattctcccacctgggcctctcaaagaactaggattacagacgtaagccactgcactcagcactttttattaaaaaaagagtgtcttgcactgtcacccaggctagagcacagtggcaggattttggctcacgccagcatagtaattcctaacctcaagcaatcctcccatctcagctttccaaaatgctgacgtcataggtgccaatctctatttactctaaataatgaca

SEQ ID NO: 288456 - DNA, 403 bp, Homo sapiens
ttatatccagttaagagataaagaggatagtagacatattttttggactgtgtggtactttacaatgtgacatattacctgtgaagataaagctttgaaaacattacaatttgaattacagcgtaaagctgacaataatgacagaaacagcaacaggtaacattcagtgctcacttaataattccctgccttaaaatgtactctcctgaatattagctaggagtactaattcttttatgtagaaagcacaacaaattgaaccaaaggcttattaggatatgcctagaagtcttttgtaatgtatcccatatcatttaaaaaatcatttgcctctgttctaaagtattaatggattaaaaataaaaatagctgttagcttaatatacttttacttacttggcca

SEQ ID NO: 288457 - DNA, 3068 bp, Homo sapiens
ctacttttttaacattcaaactgtgttttattgtatcaccaatggattatctactttttctcatgcttcaaaaatgaaaaacttttaaaagtaattattgtctggatatctttagcccatcatgcaatgttttcataagaaaaccaagctcaacataatacgttttaagcaaacagggatttaacatttaattccaattcaccaaatctttattgaacatctgttgtcagatgtagacatcctattaaaaacaagtacctctatttcagttggtttatttctgtaccatctcctacccacagccgtaaagaagacattaaaaaaggcttactgaaattatactatatagtatttttttagataagacacacacacacttcatgtctatgacttgtttacctaagataaaagggacctaattcaacttactttagcaaacatactactgccaattaatcatttcttaacccttttaggccagtgatacatgtcttgatgtgattggtggccgggacacacctggagctaaagtagctctatggactgaacatgggcaattcaggcagaagtggagactgaataaaaatggaactatcagctcttatctcagtgatcaacttgtccttgatgttaaaggtgggcctttgatgatacccaatgttgtgtccctggatattagtttcagttccaaatctcctcattttgggtaaaggacatccttatgtataagagaaatgttaagtcatttaaaattatgcttgaagaaaattaagataggcagttttacaaacaaaacaattagcagaaaaagccaaacaacaaagcttagggtttttgttcattagtacagttgtaaaactttcatttgctacgtgaactcagaacagttctaaatttcaagcaccataaaccatgaaatgaatgtcatctgtttcttagaaacatctctagctttttgccaggaattgccatggtccttaaaaaccctcaggtagaatttatggtaggtatcaattaaccttgtttttgaattcagcaaggtcagggccaatattattcatggctgttgctttaattgggttagtcacagttttgttggtgtagaaacaaaaacacagtacctgacattcagccagagtttctttcaagagcactttgttctaaagaatcacattaaggcacgccacttatacaatcatgtattataccttttagtatttcaatttgagtcataataaggtccaatttgaggtgaataatggctaagcctgttcaaactcagcttcccatttcagacttctttgtaaatgacacattcatccaccgaaatggtgagctgaacagaagcttgtgaaaattgtgaaattgctaagcacctgcctgaacaaataatcttttcttttggaatttctattttaggaggaaattattgtgacaagactcatgtaattgtaaatcagcccctggagggagaagaaacacagaaatgggacattgaaatattgtgagagaatcaacatccctagaaagatccctagaaagagcaaagaaggaaacacatctgtcattgtcttgtggacgtggaaaggaagctactgtcctcacactcctggatcactgagcagaatgaacattttctccagcctctgagactatcgctcttaaccatggaaaagctcaaaatattcttgccattactcagtgttcctataaagaaaatattatgatatcttggaaaggttctattcctgatctccagctgtggtgagcaagtttcctgaagtgtttattttctctcatatccaccaaacgtgaatcctgttcctgatggcccgttattggacactggtgatgctattatcctgtattatttattaatatcctacctagatgcttgtatgagtacaaagcataaagaaacagatttctataggtcaagtccatcactattttgccaacacccagcatgcagtcacattttttcagccaaccaccttgcacacaccatcatcactcaaacacttttcctcagcatcacacactttcacagtgtttctcatcacttgcagtgctatttcatcacatgcaaactgcaacctctgttcaaagtcatttcatcactttgtcacacttacacccccagtgcaagggcacctcacagcattatcgttcaggcacatcaaggtgcaccacagcacagtcatattttcattgtcagctcatttgtttccatccaggtccttccaacactacaacacaagtaccaaatacaactaacctattggccaaaccttgcaccttgtatacgttgtaaagccaagaacatccctattaggtgaccaatgacctctataagcagtgggttaccctggtctccatggttgagcacgttcatacctaagtacattctaatgggacgaaagggcattcaaattattatagaaaaagtataatgatgcctcagagaaggaaaaattcacagaatatatgagaatataataaaaaggataagcattgtgaaaccttgtgaagcattatcacaataatatataaaagggaaacgtcgtggagtctatacaattcatacatacataaagtagtaagtggaacaagtcctacagtatctacaacgtccccatgtgtgttagctcaactgttgtacatgctacaacgatacggtaacaccacaggggtgaggcgaacactaccctatgtgacatctgaatatccaagtgagctacatacccacccctatttatagggggacaacatgccaacaaacatgttaacaccacgggagacacaggtgaccagaccacataataacatgaggcagcaaagagccaattaaaaaccacacaaattgggcgacaacagagaaaaagggcgtcattctcacacaacacgcgataccaccgcagatgtacacacaaaaagcagccgagtgaaacaaagtacaagcaagtaaacgaaaccacagtactgagtacgtacaacaccacatcgcaccacagcaggagccaaagaaactagtgagaagtggtaagaacaacaacactgcgcggacc

SEQ ID NO: 288458 - DNA, 2252 bp, Homo sapiens
ctctcaagcccattgactatgtttttgaagaaccctccatcagcctttttgctctggagcattgtgagggaagagagttacatctagaagaggctgtgaactctgttctgaacaaggacctacacttctacacccagtctgtgtgggtaaaaagtggactatggatagcttatgaaggatccaatttcttgggaagacaaatcctactcaggcctaatgagatcccaaactggacagcattcagcagatggaaaacaattggttccctccgtcctatgaagcagcctgcagtgtacatcagaataaagaaccgtgcccagggtgaatatctgacagtcactggaagtctagcagacaccagggcaacatctgtgtgcatttctccctatagtggaaagcatactcagatctggtactactgccgaggactctttaaatccaaggccagtgatacatgtcttgatgtgattggtggccgggacacacctggagctaaagtagctctatggactgaacatgggcaattcaggcagaagtggagactgaataaaaatggaactatcagctcttatctcagtgatcaacttgtccttgatgttaaaggaggaaattattgtgacaagactcatgtaattgtaaatcagcccctggagggagaagaaacacagaaatgggacattgaaatattgtgagagaatcaacatccctagaaagatccctagaaagagcaaagaaggaaacacatctgtcattgtcttgtggacgtggaaaggaagctactgtcctcacactcctggatcactgagcagaatgaacattttctccagcctctgagactatcgctcttaaccatggaaaagctcaaaatattcttgccattactcagtgttcctataaagaaaatattatgatatcttggaaaggttctattcctgatctccagctgtggtgagcaagtttcctgaagtgtttattttctctcatatccaccaaacgtgaatcctgttcctgatggcccgttattggacactggtgatgctattatcctgtattatttattaatatcctacctagatgcttgtatgagtacaaagcataaagaaacagatttctataggtcaagtccatcactattttgccaacacccagcatgcagtcacattttttcagccaaccaccttgcacacaccatcatcactcaaacacttttcctcagcatcacacactttcacagtgtttctcatcacttgcagtgctatttcatcacatgcaaactgcaacctctgttcaaagtcatttcatcactttgtcacacttacacccccagtgcaagggcacctcacagcattatcgttcaggcacatcaaggtgcaccacagcacagtcatattttcattgtcagctcatttgtttccatccaggtccttccaacactacaacacaagtaccaaatacaactaacctattggccaaaccttgcaccttgtatacgttgtaaagccaagaacatccctattaggtgaccaatgacctctataagcagtgggttaccctggtctccatggttgagcacgttcatacctaagtacattctaatgggacgaaagggcattcaaattattatagaaaaagtataatgatgcctcagagaaggaaaaattcacagaatatatgagaatataataaaaaggataagcattgtgaaaccttgtgaagcattatcacaataatatataaaagggaaacgtcgtggagtctatacaattcatacatacataaagtagtaagtggaacaagtcctacagtatctacaacgtccccatgtgtgttagctcaactgttgtacatgctacaacgatacggtaacaccacaggggtgaggcgaacactaccctatgtgacatctgaatatccaagtgagctacatacccacccctatttatagggggacaacatgccaacaaacatgttaacaccacgggagacacaggtgaccagaccacataataacatgaggcagcaaagagccaattaaaaaccacacaaattgggcgacaacagagaaaaagggcgtcattctcacacaacacgcgataccaccgcagatgtacacacaaaaagcagccgagtgaaacaaagtacaagcaagtaaacgaaaccacagtactgagtacgtacaacaccacatcgcaccacagcaggagccaaagaaactagtgagaagtggtaagaacaacaacactgcgcggacc

SEQ ID NO: 288459 - DNA, 2158 bp, Homo sapiens
ccacatgtggctagtggccacctcccgcgaagcagcccggccactcacctcctaccaccttttacctatttctccttctccgcaggcctccctagcactaccagttgtcttgttggcgagtcctttgtgactcccactatacaagcccctcaaggccaggcttcgccctgaacggtgcctgggcggagcagacgctccatcaacgctgtccccgcctgagtccacgtccaggggatccgcaggcgccgtaccctgcttccacgcgccggggccgcccctcgcccggcctcccgcaggcccacccctcgccaggcccaggcccatccccgggctgttcgctggaaatcgtggacgtgactgggaggagcctgcccgccccggctcgctgcgccgcgcgcacagggcccgcgccagcgaccatggcggagcccacagtgtgctccttcctcaccaaggtgctgtgcgcccacggcggccgcatgttcctgaaggacctgcgcggccacgtggagctgtcggaggccaggctccgggacgtgctgcagcgcgccgggcccgagcgtttcctgctgcaggaggtggagacgcaggagggcctcggggacgcggaggccgaggcggcggccggcgcggtgggcggtggcggcacctccgcctggagggtggtggccgtgtcctctgtgcgcctctgcgcccgctaccagcgcggcgagtgccaggcctgcgaccagctgcacttctgccgccggcacatgctgggcaagtgccccaaccgggactgctggtctacctgtaccctttcccatgatatccacacacctgtcaacatgcaggtcctgaaaagccatggactttttggtctcaatgaaaaccagcttcggatcctgcttttgcagaatgacccctgtcttttaccagaggtctgtttgctctacaacaaaggggaagccctgtatggctactgcaacctcaaggataaatgcaacaagtttcatgtgtgcaaatcctttgtgaaaggagaatgcaaacttcagacctgcaaacggtcccatcagcttatccatgctgcatctttgaagctgctacaggaccaaggactgaatattccaagtgttgttaattttcagataatctccactacaagcatataagctgcacaagatgcttgaaaatacagataattcatcaccttcgactgagcattcacaaggccttgagaagcaaggagtgcacgcagctggagctgcagaagctggtcctctggcttctgtccctgctcagtcggccaagaagccctgcccagtgtcttgcgagaagtaaagaagatggaaaaggagaaaatgtccttttggaagaatacatttgggcatgggtggttggggatggggtgggacattgaacaggcaaagagaggctaaaattgagtgcagatggggctagtccagggcaagtgctgaagatggcagctgctatctgcagctcctaggtgctttcctcaggctgggtagatggagctctgctgacttctgtggtccaccattgtttttctatcaatttatattgtggcaatcctagagtactttgcactcatttttttttttcacttaatattgtctcataagcatctttctatatttgttcacatcgtacataatcatgtttttgcacagatacattaatattatcatagtttgtttaactacttggctttttctaacagtttttttttttgagatggtcttgctctgttgcccaggctggagtgcagtgacgtgatctcggctcactgcagccttgacttcctgggctcaagtgatcatcccacctcagcctcctgagtagctgggactacaggtatgcaccacgaccagctaattttttgtattttttttttgtagagagggtattttgccatgttgcccaggctagtcttgaactcctgggctcaagcgatctgcctgcttcagcctcccagagtgctaggattacaggcatgagccactgcacccagcctcttaacaaattttgaatataactcctgtcttaaaatctgcagaatattgaatttttccagctattttttacttttgcttagcttatagatgctaaaggatactgtcatttgcatttttaaaaatatatgtatgagtgaatagtt

SEQ ID NO: 288460 - DNA, 1076 bp, Homo sapiens
tggccgggcgcggtggctcacgcctgtaatcccagcactgtgggaggctgaggtgggcggatcacgaggtcaggagatcgagaccatcctggctaacacggtgaaaccccatctctactaaaaataacaaaaaaattagccgggcgactataggtgcatgccaccatactcagctaatctttttaggtttttagtagagacaaggtctcactatgttgcccaggctggtcttgaactcctaagctcaagcagtcctcccgccttggcctctgaatgtgctgggattacaggcatgagccactatgcctaaccatattttttccaatattaaaaaatctttttttccccctaaggaatgtgttatataaggtcaacatgtttttagtgcttcagtttgacttgtctacatctaaagttaactctttaaggcttacatttatgattataattctttccatcgagggatttagtctccattattgtcatgtttcttgatttttttcattatacttggttcttctttttgtctaggttttatatataccttaattaattctttcttggctgttttatatctatgttgctgtcagcatgggaatctctattattagaaagctattaacttttaaaatatgtatcttttggtgattttctttgttctaacagttttagatggcctgtttgctctttctaaatataaaatcataggtatttctattttgtttttgtgtttcataaaattgtaataagtttttttgatattttttcattacatatgaagttaattgttggttttaaacaaatgttctttgttaggataacagaaataacatcttctattcttgtttgttggaagctaaaagcttgataaaaggaattggtgtcttttgatacaatcaaatttttatcacttaaattgcctaatatgattataataagggtttttgtaatattaaaacatccttaaattcctgagataaaactctacctggttatagtatatgttcttttaatgtattatctttcctatttgctgtacatctatacattcataaataaaattcatttatatttta

SEQ ID NO: 288461 - DNA, 989 bp, Homo sapiens
tggccgggcgcggtggctcacgcctgtaatcccagcactcagcttccctagtagccgggactataggtgcatgccaccatactcagctaatctttttaggtttttagtagagacaaggtctcactatgttgcccaggctggtcttgaactcctaagctcaagcagtcctcccgccttggcctctgaatgtgctgggattacaggcatgagccactatgcctaaccatattttttccaatattaaaaaatctttttttccccctaaggaatgtgttatataaggtcaacatgtttttagtgcttcagtttgacttgtctacatctaaagttaactctttaaggcttacatttatgattataattctttccatcgagggatttagtctccattattgtcatgtttcttgatttttttcattatacttggttcttctttttgtctaggttttatatataccttaattaattctttcttggctgttttatatctatgttgctgtcagcatgggaatctctattattagaaagctattaacttttaaaatatgtatcttttggtgattttctttgttctaacagttttagatggcctgtttgctctttctaaatataaaatcataggtatttctattttgtttttgtgtttcataaaattgtaataagtttttttgatattttttcattacatatgaagttaattgttggttttaaacaaatgttctttgttaggataacagaaataacatcttctattcttgtttgttggaagctaaaagcttgataaaaggaattggtgtcttttgatacaatcaaatttttatcacttaaattgcctaatatgattataataagggtttttgtaatattaaaacatccttaaattcctgagataaaactctacctggttatagtatatgttcttttaatgtattatctttcctatttgctgtacatctatacattcataaataaaattcatttatatttta

SEQ ID NO: 288462 - DNA, 2083 bp, Homo sapiens
ttgtgttgagctttttactttcattgtcaacgatatttctgaaagcccttatgctctgcatattttgtttctttttttctagtccagatttctcctggtgataattaaaaaaatttttacatttaattattactattatttacacttaccattttactatgtatatttttgtagtaagctatcttaaatctttaatggaaacagtgtagggtataaatgcatttcctttacattgagagacttgctggacctttacttgtttatgttctgtttttatatcttatcattatgcttttatatgtgatgttattggtcctctgtcatctttgttgcagtattttattcaattctataatagtctactttaatcttagttttgttggtattcattctgtaaaatattttatataaccatgcctttctctgatttttactcatgattaagctgttagaaagttatcgcattatagttggaaaagagttttctttggtaatttatcggggtttttgatgtcaagtcgcatgtctatagactctacaaattcaatgtattctaaattgaattatgaattttcctttagtcttgttcctgcttttatttccttatttttgaatgtcaccactatctacctaatgacatagacaaaaagctgtaaattgtcctatacttttttttctccttgttccctttgtcaaattggttacccagtgttggagagtttcttcccctcaaaaacctttcaaatatttatccttctctgcccctttctttccaccctgtacatactgccttgtttcaaaccctcatcatcttcctgcatatatcctacagatgcataaactcagtggttttcaagtcatctgttatgggagtttttggtaaaaggtgccctgttcccactgcagtgatggtagccctgttttaatctttaatagaataagcgtttgtggatttcactggtctccttaccactcttcacttctcctgccttccatctggctgcctgacattttgaaaacaaagctaatcatatggcttttttcctgctgaaaccttccttggtcctcatcatgtagggtggtatttgtaaactcaaaacgcctgcagggactagaaaggtgagttaaatggatgaagtgaactggatgcaagagcagtgggagaagggagaagtgctgtggcaaactgtcccatctaaaagggacgcctgcctcttgtatccacgtgggaatgtgggcccactttgtcatagtgcccagttttttaaaaagaagccagaaattcagattgttatgagaaatgttctgattgaatattgactttagtcgagtttttaaaatgcagaccaacattgtatgtacttgacctacttggaatttctggaatgtgctattttgtcttgtgattctctgtaaatgatattccctgttttttttttttttttttttctttttttttcctttggaaagggggttttgggggcccagaggggggggttacggggggaggactctcaggtctcacggggaacctctccggtcctcccgggtctcaaggtgatttctccgggcgtcaagccctcccagagtagctggggcactatgggcttggtccaccacgagcgtgggtaactttgggtgtttttaggacaaaatgggcgtctcccatgttggcgcgggggggcgtggaatcctaccctatgtgtcacccatttgcctccaagtgggggatataggggtgagagcaatggcataaagccagagtgttccctctttataaagagggaagctttttttaactcaaaacgttaggcaaattgggtctctaacagccagggggggggtttgggcctccaaaagggggcttgtgggactatagagggaaaaaacaatttagttgaaggagggcagggggggttgacaacacctgggaccaatatcttgggtgaccggggggagacattggcatagacaatagttttgtagagtaacaagggagagtgctccctaaagaattacctgcgggacagagtaattgcgtcgtgttagactgattacgtattgaattttgatctaaaagtgt

SEQ ID NO: 288463 - DNA, 3134 bp, Homo sapiens
ttgtgttgagctttttactttcattgtcaacgatatttctgaaagcccttatgctctgcatattttgtttctttttttctagtccagatttctcctggtgataattaaaaaaatttttacatttaattattactattatttacacttaccattttactatgtatatttttgtagtaagctatcttaaatctttaatggaaacagtgtagggtataaatgcatttcctttacattgagagacttgctggacctttacttgtttatgttctgtttttatatcttatcattatgcttttatatgtgatgttattggtcctctgtcatctttgttgcagtattttattcaattctataatagtctactttaatcttagttttgttggtattcattctgtaaaatattttatataaccatgcctttctctgatttttactcatgattaagctgttagaaagttatcgcattatagttggaaaagagttttctttggtaatttatcggggtttttgatgtcaagtcgcatgtctatagactctacaaattcaatgtattctaaattgaattatgaattttcctttagtcttgttcctgcttttatttccttatttttgaatgtcaccactatctacctaatgacatagacaaaaagctgtaaattgtcctatacttttttttctccttgttccctttgtcaaattggttacccagtgttggagagtttcttcccctcaaaaacctttcaaatatttatccttctctgcccctttctttccaccctgtacatactgccttgtttcaaaccctcatcatcttcctgcatatatcctacagatgcataaactcagtggttttcaagtcatctgttatgggagtttttggtaaaaggtgccctgttcccactgcagtgatggtagccctgttttaatctttaatagaataagcgtttgtggatttcactggtctccttaccactcttcacttctcctgccttccatctggctgcctgacattttgaaaacaaagctaatcatatggcttttttcctgctgaaaccttccttggtcctcatcatgtagggtggtatttgtaaactcaaaacgcctgcagggactagaaaggtgagttaaatggatgaagtgaactggatgcaagagcagtgggagaagggagaagtgctgtggcaaactgtcccatctaaaagggacgcctgcctcttgtatccacgtgggaatgtgggcccactttgtcatagtgcccagttttttaaaaagaagccagaaattcagattgttatgagaaatgttctgattgaatattgactttagtcgagtttttaaaatgcagaccaacattgtatgtacttgacctacttggaatttctggaatgtgctattttgtcttgtgattctctgtaaatgatattccctgttttttttttttttttttttcttttttcctttgagatggagtctctgtcgcccaggctggagtacagtggcatgatctcagctcactgcaacctccgtctcccaggttcaagtgattctcctgcctcagcctcccgagtagctgggattataggcatgtaccaccatgcctggctaatttttgtatttttagtagagatggggtttcaccatgttggccaggctggtcttgaactcctcacctcaagtgatccacccacctcgccctcccaaagtgttagtattataggcgtgagccactgcactcagcctgatgttccctcttttataagtgccattccttcttcctacctcacaacctagcaaaattggattcttcaaaacgccaggttggcctttcttgactccaaaagaggtgactcttgtagcattcttacaggcctaacatagcacttactttatgttgcaatgctgtgtgcaatgctgtgtttttttactcactagctctgagcaaaacattatttattcttggtaattgtaacacttggtagtgaagacatattttttgccatataatggattatactttgtatttgaatccatgtgaatcagtagcatattggtcttcattgtttttcctccttctccgacgtttttttgagacagggtctcactctgttgcccaggctggagtgcagggcacaattacagctccctgcagccttgatttctcaggctcaagccatcctcttgcctcagcttccctagtagccgggactataggtgcatgccaccatactcagctaatctttttaggtttttagtagagacaaggtctcactatgttgcccaggctggtcttgaactcctaagctcaagcagtcctcccgccttggcctctgaatgtgctgggattacaggcatgagccactatgcctaaccatattttttccaatattaaaaaatctttttttccccctaaggaatgtgttatataaggtcaacatgtttttagtgcttcagtttgacttgtctacatctaaagttaactctttaaggcttacatttatgattataattctttccatcgagggatttagtctccattattgtcatgtttcttgatttttttcattatacttggttcttctttttgtctaggttttatatataccttaattaattctttcttggctgttttatatctatgttgctgtcagcatgggaatctctattattagaaagctattaacttttaaaatatgtatcttttggtgattttctttgttctaacagttttagatggcctgtttgctctttctaaatataaaatcataggtatttctattttgtttttgtgtttcataaaattgtaataagtttttttgatattttttcattacatatgaagttaattgttggttttaaacaaatgttctttgttaggataacagaaataacatcttctattcttgtttgttggaagctaaaagcttgataaaaggaattggtgtcttttgatacaatcaaatttttatcacttaaattgcctaatatgattataataagggtttttgtaatattaaaacatccttaaattcctgagataaaactctacctggttatagtatatgttcttttaatgtattatctttcctatttgctgtacatctatacattcataaataaaattcatttatatttta

SEQ ID NO: 288464 - DNA, 1607 bp, Homo sapiens
ccacatgtggctagtggccacctcccgcgaagcagcccggccactcacctcctaccaccttttacctatttctccttctccgcaggcctccctagcactaccagttgtcttgttggcgagtcctttgtgactcccactatacaagcccctcaaggccaggcttcgccctgaacggtgcctgggcggagcagacgctccatcaacgctgtccccgcctgagtccacgtccaggggatccgcaggcgccgtaccctgcttccacgcgccggggccgcccctcgcccggcctcccgcaggcccacccctcgccaggcccaggcccatccccgggctgttcgctggaaatcgtggacgtgactgggaggagcctgcccgccccggctcgctgcgccgcgcgcacagggcccgcgccagcgaccatggcggagcccacagtgtgctccttcctcaccaaggtgctgtgcgcccacggcggccgcatgttcctgaaggacctgcgcggccacgtggagctgtcggaggccaggctccgggacgtgctgcagcgcgccgggcccgagcgtttcctgctgcaggaggtggagacgcaggagggcctcggggacgcggaggccgaggcggcggccggcgcggtgggcggtggcggcacctccgcctggagggtggtggccgtgtcgactataggtgcatgccaccatactcagctaatctttttaggtttttagtagagacaaggtctcactatgttgcccaggctggtcttgaactcctaagctcaagcagtcctcccgccttggcctctgaatgtgctgggattacaggcatgagccactatgcctaaccatattttttccaatattaaaaaatctttttttccccctaaggaatgtgttatataaggtcaacatgtttttagtgcttcagtttgacttgtctacatctaaagttaactctttaaggcttacatttatgattataattctttccatcgagggatttagtctccattattgtcatgtttcttgatttttttcattatacttggttcttctttttgtctaggttttatatataccttaattaattctttcttggctgttttatatctatgttgctgtcagcatgggaatctctattattagaaagctattaacttttaaaatatgtatcttttggtgattttctttgttctaacagttttagatggcctgtttgctctttctaaatataaaatcataggtatttctattttgtttttgtgtttcataaaattgtaataagtttttttgatattttttcattacatatgaagttaattgttggttttaaacaaatgttctttgttaggataacagaaataacatcttctattcttgtttgttggaagctaaaagcttgataaaaggaattggtgtcttttgatacaatcaaatttttatcacttaaattgcctaatatgattataataagggtttttgtaatattaaaacatccttaaattcctgagataaaactctacctggttatagtatatgttcttttaatgtattatctttcctatttgctgtacatctatacattcataaataaaattcatttatatttta

SEQ ID NO: 288465 - DNA, 2750 bp, Homo sapiens
ttgtgttgagctttttactttcattgtcaacgatatttctgaaagcccttatgctctgcatattttgtttctttttttctagtccagatttctcctggtgataattaaaaaaatttttacatttaattattactattatttacacttaccattttactatgtatatttttgtagtaagctatcttaaatctttaatggaaacagtgtagggtataaatgcatttcctttacattgagagacttgctggacctttacttgtttatgttctgtttttatatcttatcattatgcttttatatgtgatgttattggtcctctgtcatctttgttgcagtattttattcaattctataatagtctactttaatcttagttttgttggtattcattctgtaaaatattttatataaccatgcctttctctgatttttactcatgattaagctgttagaaagttatcgcattatagttggaaaagagttttctttggtaatttatcggggtttttgatgtcaagtcgcatgtctatagactctacaaattcaatgtattctaaattgaattatgaattttcctttagtcttgttcctgcttttatttccttatttttgaatgtcaccactatctacctaatgacatagacaaaaagctgtaaattgtcctatacttttttttctccttgttccctttgtcaaattggttacccagtgttggagagtttcttcccctcaaaaacctttcaaatatttatccttctctgcccctttctttccaccctgtacatactgccttgtttcaaaccctcatcatcttcctgcatatatcctacagatgcataaactcagtggttttcaagtcatctgttatgggagtttttggtaaaaggtgccctgttcccactgcagtgatggtagccctgttttaatctttaatagaataagcgtttgtggatttcactggtctccttaccactcttcacttctcctgccttccatctggctgcctgacattttgaaaacaaagctaatcatatggcttttttcctgctgaaaccttccttggtcctcatcatgtagggtggtatttgtaaactcaaaacgcctgcagggactagaaaggtgagttaaatggatgaagtgaactggatgcaagagcagtgggagaagggagaagtgctgtggcaaactgtcccatctaaaagggacgcctgcctcttgtatccacgtgggaatgtgggcccactttgtcatagtgcccagttttttaaaaagaagccagaaattcagattgttatgagaaatgttctgattgaatattgactttagtcgagtttttaaaatgcagaccaacattgtatgtacttgacctacttggaatttctggaatgtgctattttgtcttgtgattctctgtaaatgatattccctgttttttttttttttttttttcttttttcctttgagatggagtctctgtcgcccaggctggagtacagtggcatgatctcagctcactgcaacctccgtctcccaggttcaagtgattctcctgcctcagcctcccgagtagctgggattataggcatgtaccaccatgcctggctaatttttgtatttttagtagagatggggtttcaccatgttggccaggctggtcttgaactcctcacctcaagtgatccacccacctcgccctcccaaagtgttagtattataggcgtgagccactgcactcagcctgatgttccctcttttataagtgccattccttcttcctacctcacaacctagcaaaattggattcttcaaaacgccaggttggcctttcttgactccaaaagaggtgactcttgtagcattcttacaggcctaacatagcacttactttatgttgcaatgctgtgtgcaatgctgtgtttttttactcactagctctgagcaaaacattatttattcttggtaattgtaacacttggtagtgaagacatattttttgccatataatggattatactttgtatttgaatccatgtgaatcagtagcatattggtcttcattgtttttcctccttctccgacgtttttttgagacagggtctcactctgttgcccaggctggagtgcagggcacaattacagctccctgcagccttgatttctcaggctcaagccatcctcttgcctcagcttccctagtagccgggactataggtgcatgccaccatactcagctaatctttttaggtttttagtagagacaaggtctcactatgttgcccaggctggtcttgaactcctaagctcaagcagtcctcccgccttggcctctgaatgtgctgggattacaggcatgagccactatgcctaaccatattttttccaatattaaaaaatctttttttccccctaaggaatgtgttatataaggtcaacatgtttttagtgcttcagtttgacttgtctacatctaaagttaactctttaaggcttacatttatgattataattctttccatcgagggatttagtctccattattgtcatgtttcttgatttttttcattatacttggttcttctttttgtctaggttttatatataccttaattaattctttcttggctgttttatatctatgttgctgtcagcatgggaatctctattattagaaagctattaacttttaggacctttggcgattcccttgtctaccagtttaaagccccggtgcttctctcctcctcgcttcc

SEQ ID NO: 288466 - DNA, 901 bp, Homo sapiens
tggtggcgcgtgcttgtaatcccagctactcaggagtctgaggcaggagaatcgcttgaactcctaagctcaagcagtcctcccgccttggcctctgaatgtgctgggattacaggcatgagccactatgcctaaccatattttttccaatattaaaaaatctttttttccccctaaggaatgtgttatataaggtcaacatgtttttagtgcttcagtttgacttgtctacatctaaagttaactctttaaggcttacatttatgattataattctttccatcgagggatttagtctccattattgtcatgtttcttgatttttttcattatacttggttcttctttttgtctaggttttatatataccttaattaattctttcttggctgttttatatctatgttgctgtcagcatgggaatctctattattagaaagctattaacttttaaaatatgtatcttttggtgattttctttgttctaacagttttagatggcctgtttgctctttctaaatataaaatcataggtatttctattttgtttttgtgtttcataaaattgtaataagtttttttgatattttttcattacatatgaagttaattgttggttttaaacaaatgttctttgttaggataacagaaataacatcttctattcttgtttgttggaagctaaaagcttgataaaaggaattggtgtcttttgatacaatcaaatttttatcacttaaattgcctaatatgattataataagggtttttgtaatattaaaacatccttaaattcctgagataaaactctacctggttatagtatatgttcttttaatgtattatctttcctatttgctgtacatctatacattcataaataaaattcatttatatttta

SEQ ID NO: 288467 - DNA, 410 bp, Homo sapiens
agctggagctgcagaagctggtcctctggcttctgtccctgctcagtcggccaagaagccctgcccaggtaaaccttaaagggggtcagtgaactaagaagaagcttgtccagcttggaagatctgaaaacaagccttctgtttagctttaatttgtaaccattcattcatttaatgatagatttgtaatggtcataataatatctacctcacagtgtcttgcgagaagtaaagaagatggaaaaggagaaaatgtccttttggaagaatacatttgggcatgggtggttggggatggggtgggacattgaacaggcaaagagaggctaaaattgagtgcagatggggctagtccagggcaagtgctgaagatggcagctgctatctgcagctcctaggtgctttcctca

SEQ ID NO: 288468 - DNA, 289 bp, Homo sapiens
ctgccaaaaaaaaaagaaaaactaatatttcaggtgttccctcatttctgtaccaggtctgtttgctctacaacaaaggggaagccctgtatggctactgcaacctcaaggataaatgcaacaagtttcatgtgtgcaaatcctttgtgaaaggagaatgcaaacttcagacctgcaaacggtcccatcagcttatccatgctgcatctttgaagctgctacaggaccaaggactgaatattccaagtgttgttaattttcagataatctccactacaagcatataagc

SEQ ID NO: 288469 - DNA, 1666 bp, Homo sapiens
gatagaccatccgtgtggcgcgcgggtccagatgaggtaagtgaacatggtgcatagatgttcccgaggagatcctggtcttgactagtgctatggattctcgagctaatataaaagcagtccggcggaacgcgaggcgttctgacaactgttgcacgagggagttctgagggtcacttaccatcggatctgttgcataccaggacgtcctacaggcgatgctcgatgatgctaaagtaatcagccccgggctcggccactgcactcagcctgatgttccctcttttataagtgccattccttcttcctacctcacaacctagcaaaattggattcttcaaaacgccaggttggcctttcttgactccaaaagaggtgactcttgtagcattcttacaggcctaacatagcacttactttatgttgcaatgctgtgtgcaatgctgtgtttttttactcactagctctgagcaaaacattatttattcttggtaattgtaacacttggtagtgaagacatattttttgccatataatggattatactttgtatttgaatccatgtgaatcagtagcatattggtcttcattgtttttcctccttctccgacgtttttttgagacagggtctcactctgttgcccaggctggagtgcagggcacaattacagctccctgcagccttgatttctcaggctcaagccatcctcttgcctcagcttccctagtagccgggactataggtgcatgccaccatactcagctaatctttttaggtttttagtagagacaaggtctcactatgttgcccaggctggtcttgaactcctaagctcaagcagtcctcccgccttggcctctgaatgtgctgggattacaggcatgagccactatgcctaaccatattttttccaatattaaaaaatctttttttccccctaaggaatgtgttatataaggtcaacatgtttttagtgcttcagtttgacttgtctacatctaaagttaactctttaaggcttacatttatgattataattctttccatcgagggatttagtctccattattgtcatgtttcttgatttttttcattatacttggttcttctttttgtctaggttttatatataccttaattaattctttcttggctgttttatatctatgttgctgtcagcatgggaatctctattattagaaagctattaacttttaaaatatgtatcttttggtgattttctttgttctaacagttttagatggcctgtttgctctttctaaatataaaatcataggtatttctattttgtttttgtgtttcataaaattgtaataagtttttttgatattttttcattacatatgaagttaattgttggttttaaacaaatgttctttgttaggataacagaaataacatcttctattcttgtttgttggaagctaaaagcttgataaaaggaattggtgtcttttgatacaatcaaatttttatcacttaaattgcctaatatgattataataagggtttttgtaatattaaaacatccttaaattcctgagataaaactctacctggttatagtatatgttcttttaatgtattatctttcctatttgctgtacatctatacattcataaataaaattcatttatatttta

SEQ ID NO: 288470 - DNA, 433 bp, Homo sapiens
gatcccccggaagcacactgcaacacgggatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288471 - DNA, 208 bp, Homo sapiens
actactactgctcgaattcaagcttctaacgatgtacggggacgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288472 - DNA, 1770 bp, Homo sapiens
acccggctacttccgctgctgtttcgtagccgactgctgaaggctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288473 - DNA, 260 bp, Homo sapiens
aagtataaatgtatatagaagaggaaaagctagccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288474 - DNA, 1986 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctgaacaacacacaacaaagacacaacaacaaaaaccggggggcaacatggggggggggggaaaagagcgtataaaaggcacacggccaaagcgtcccgccaccgtttggtacaggggaacaccggggcccaaaggagcgaaactcaaacacggaca

SEQ ID NO: 288475 - DNA, 2303 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctgaaaaaaaaaaatacaaaaaaatataaatgaaaagaagtgaaaaacaaatggagaaaaaagaagaagggggaagaaaaaaaggagaacgagaatacgaaagagagggcgcggggggaagcatatcaggggaggaggagaggaaaaaagccaggagaggaaaaaaccgcacatagggcactatcaaacacacacgaaccccgacgggcggtagcacaaacgcaaacgtacagcgacaaggagcggacacgggacccacccagtacgggagagcacagaagcaagccaccataggacgctccgagagaacaagaaggcgggacgcacaccacagcgtacgggacacccgaccgaacacaacaaaagggcgcaaacaacaaacaaaacgacagacgccaagaaagcaaaacagcgacaacagaggaccgagacgacacgccgacgcagagcaaagacagccagcaggaccaccag

SEQ ID NO: 288476 - DNA, 1858 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctgaaggccccaaaaggggaaccgagctg

SEQ ID NO: 288477 - DNA, 1611 bp, Homo sapiens
gccctgggaattccccgatcggtgtgttataccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288478 - DNA, 1880 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggttgtgacgttcccaacctaaggtacagggatgctggtgcttccataggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288479 - DNA, 1420 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagagaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288480 - DNA, 1804 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288481 - DNA, 1696 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatccccagggggccggtaccgagctcgattt

SEQ ID NO: 288482 - DNA, 1699 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatacatgcaagcccgtacatcccgtactcacagg

SEQ ID NO: 288483 - DNA, 1611 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatataagtgaaaagtttgccttctgacctcatttccttcttgatcagtgaacactaacattttggggacaacttagtcaattggttttccttacaacaaaataaagtaaaatgtagcagtctg

SEQ ID NO: 288484 - DNA, 1610 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagatgaaggggctccccagtatttaaccttttggaaaaaacctaaactact

SEQ ID NO: 288485 - DNA, 1662 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcggggaacaatattacacacagcaatgaatacgactagagacgatcgtattcgcgcgtcggtacacgcgcagatgcttgtgctccgcttctgggctaa

SEQ ID NO: 288486 - DNA, 1761 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288487 - DNA, 1310 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288488 - DNA, 1465 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288489 - DNA, 1555 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288490 - DNA, 1637 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagcctttctttatttcttcccttccttctccttggtgtatttgtcctgtgagtgtctgactctatcactttcaaagctgtgctgtgatttgggtctttagatgaggcttcatgccctggcataagcaaagagcctgatacagagtggcgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288491 - DNA, 1531 bp, Homo sapiens
  misc_feature (1524)..(1524): n is a, c, g, or t
  misc_feature (1529)..(1529): n is a, c, g, or t
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaatcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctgggggggggggggggggngaaanct

SEQ ID NO: 288492 - DNA, 1186 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaaggaaggcagtggaggctaacagcgcgtgaggg

SEQ ID NO: 288493 - DNA, 771 bp, Homo sapiens
atttagcatgcacattgcactccagcctgggcagcacgagcgaaactccatctcaaacagaaagagaaaaagcgagagagagcgcgagctcccgggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288494 - DNA, 631 bp, Homo sapiens
aataggctagtagaggccgcgtgttactcgtgagagggtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288495 - DNA, 1083 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagccaacctgggaactgaccaggactctggaaattcctcatgtaaataccgtctgctccatggcttcccacgtcaggtcctggcagctgttctcccagtcg

SEQ ID NO: 288496 - DNA, 1207 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagagaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagaagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288497 - DNA, 960 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288498 - DNA, 1143 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagagaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288499 - DNA, 661 bp, Homo sapiens
  misc_feature (22)..(22): n is a, c, g, or t
gctctatggagctgcaggaatncttcacgaggtcacttcccaggttggctgaaggctttgatgtcagcactgatgtgatccgaagagttttaaaaagcaagtttttacccacattggagcagaagctgaagcaggatcaacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaatcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288500 - DNA, 569 bp, Homo sapiens
gggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctgctgcctctttggtgctctttggggtgggatggtttacctgtgaaccttggagagagggaaggacaaaggcagaaaggaaggatccctggtcagtaaacattgggagagagatggaaccag

SEQ ID NO: 288501 - DNA, 1346 bp, Homo sapiens
ggcacgagggtttagagagttcggcatgcttacaggcagttattgttctaggtgttcagctccccgggaccactggtcccttcattagtgacgtatttcatcatcagtttaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288502 - DNA, 1832 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288503 - DNA, 1852 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctgaaaaagaacatgaaaaaaat

SEQ ID NO: 288504 - DNA, 1619 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagaagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288505 - DNA, 1690 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttacaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288506 - DNA, 1779 bp, Homo sapiens
cctgaaaggaacttacaaaagattttgctaacaaaacccccagcgggcgtttaaaatttaaaaaacgaggcatactatacgtctaggtacgaaggctgggtggcgctggtttgcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagaggtaccggcttctccccgggccctcagcttgaagcagggcctcgtgccccggcgctccaggccgcgcccccttggcgccgggtgtcctgccgctgcttgcgcagcggcccttgtttcttcttacccgttgttaggggcgcagcgtcaggtgttcagctcccctgggaccactggtcccttcattagtgacgtatttcatcatcagtttagagagttcggcatgcttacaggcagttattgttctaggtgttagctttctgggtgtacggagcagctctaagccggcaacatggcccggttgcccttgcgatcaaagagaagagggctgggcgctccatgatttagcctgaggctcttcaaacatccattctgcttccacgcatggcttctgccattggttctcttcccccagcaccctgaaacgacagaaacaagcaatccgattccagaaaattcggaggcaaatggaggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctg

SEQ ID NO: 288507 - DNA, 396 bp, Homo sapiens
ttaaaggaagacaaaggtttttaaatggggaaaaaatacaattacataattgttttgaaataattatataaagagcaataacaagggtgatgccagtctgagattggacagttactgagcagatgttcttgtagaagtcatttttgtgtaagattatgatggtctttgtgtaaggtggtggtttttgtagtttttgttatcaggcacacatcatgagaacccgctctttctggcctttcccaattctatttgtcgggtttcttaacattagtgactccatctagattctgacagttttcatgagaacttgcttttcttttctctctcaagtccttattcagtattcaacacccttaacagattagtcccactgctgagtcaggcctcttgcatgaa

SEQ ID NO: 288508 - DNA, 396 bp, Homo sapiens
ttcagctggaagaatgctggaggaatacggaactcctcccatttctcacagccacctccaactcttaaaaacgcttccaactgcctcccagcacacaaccaagggagaaaactattctgtcaaagagacggtgccaaaaggcaaaaacaaaggagctgatggcaaagaaggtagctgtgattggagctggggtcagtggcctaatttctctgaagtgctgtgtggatgagggacttgagcccacttgctttgagagaactgaagatattggaggagtgtggaggttcaaagtaagtgagattttcttgggtcttgaacaggttgtgttgttatttcagggtgaatcacagttactgatgggtcatattgagaaatttattaaacaactctgatcag

SEQ ID NO: 288509 - DNA, 3831 bp, Homo sapiens
ttcagctggaagaatgctggaggaatacggaactcctcccatttctcacagccacctccaactcttaaaaacgcttccaactgcctcccagcacacaaccaagggagaaaactattctgtcaaagagacggtgccaaaaggcaaaaacaaaggagctgatggcaaagaaggtagctgtgattggagctggggtcagtggcctaatttctctgaagtgctgtgtggatgagggacttgagcccacttgctttgagagaactgaagatattggaggagtgtggaggttcaaagagaatgtggaagatggccgagcaagtatctatcaatctgtcgttaccaacaccagcaaagaaatgtcctgtttcagtgactttccaatgcctgaagattttccaaacttcctgcataattctaaacttctggaatatttcaggatttttgctaaaaaatttgatctgctaaaatatattcagttccagacaactgtccttagtgtgagaaaatgtccagatttctcatcctctggccaatggaaggttgtcactcagagcaacggcaaggagcagagtgctgtctttgacgcagttatggtttgcagtggccaccacattctacctcatatcccactgaagtcatttccaggtatggagaggttcaaaggccaatatttccatagccgccaatacaagcatccagatggatttgagggaaaacgcatcctggtgattggaatgggaaactcaggctcagatattgctgttgagctgagtaagaatgctgctcaggtttttatcagcaccaggcatggcacctgggtcatgagccgtatctctgaagatggctatccttgggactcagtgttccacacccggtttcgttctatgctccgcaatgtactgccacgaacagctgtaaaatggatgatagaacaacagatgaatcggtggttcaaccatgaaaattatggccttgagcctcaaaacaaatacattatgaaggaacctgtactaaatgatgatgtcccaagtcgtctactctgtggagccatcaaggtgaaatctacagtgaaagagctcacagaaacttctgccatctttgaggatggaacagtggaggagaacattgatgtcatcatttttgcaacaggatatagtttctcttttcccttccttgaagattcactcgttaaagtagagaataatatggtctcactgtataaatacatattccccgctcacctggacaagtcaaccctcgcgtgcattggtctcatccagcccctaggttccattttcccaactgctgaacttcaagctcgttgggtgacaagagttttcaaaggcttgtgtagcctgccctcagagagaactatgatgatggacattatcaaaaggaatgaaaaaagaattgacctgtttggagaaagccagagccagacgttgcagaccaattatgttgactacttggacgagctcgccttagagataggtgcgaagccagatttctgctctctcttgttcaaagatcctaaactggctgtgagactctatttcggaccctgcaactcctattagtatcgcctggttgggcctgggcaatgggaaggagccagaaatgccatcttcacccagaaacaaagaatactgaagccactcaagactcgggccctgaaggattcatctaatttctcagtttcttttctgttgaaaatcctgggccttcttgctgttgttgtggcctttttttgccaacttcaatggtcctagtcagcataatgctttgggctttattatcttgtcagtcactacctcctaaagaaaaaaaaaaaggctagaagaaaaaacattacattcatgttctaattatagattttagagttaggtagtacaggtaagggggaaattgtaaagaattagcagaattaggcatatgtacaaaaccaaaattttgtcatgaaattttgcctttccacgcttccctcagttcaccaaagttaccaaaatgtaaaataaaataagactggctcaggtaagtagtgctgccaaccctgatataggggagttgtatggaaaaatagtagaattacacagcatgaaaagcagcccatggtttaaattattggacaatttaaattgtgggtaaatatttaaaactcctgaacaatgtttctgatggtcttctatccaccctacttggtaacaaagttctcagatgttaggtcatgtttcatttgctcagtcggggatcactcaaaactactagacaaaaaagtgagaggatagatttagaaaacatcagtgatgctcagataaacttttaggacctcatattaagagctaagcaaatggccacatttcctatattttgacagagatactgctggaaaaattaaaattaaaatgccataatagctacctaacaaatatatatgtttaatgtttatcataggccagacattgtgctatgtgcatatcatatgtattatttcatttaattctcacaacaattctgtgaaatggttacagctattatagtcatttcacagatgatgaaactaagattcagagcagctgatcttgtgaggcagctggaattggaactcagatttgttgaactctagaactaaagatcataatgttgtcttgtaatatatttatttacaaaacacttcattatttataaagaatttactaacagtttatcttatttatacccatacatctgctactttgggaggccctttacatagaaaacagcattctttttgctaaatatgaccaaattacttttatttataatttttgatttatatttcagctagatctaaaaagcatctgaaggaatttacaatgaaagatacctatgcaataacatttaggataatctttgacattttggaaaaataagaattgaggaaaaaaagtgtatctttcaagtagatgcaaagcattataatgactgacacttgtatctaactccagtcttacagataactaaggcaaaaagctaaataaacaatatgtaacctctaacatttggtaaaaggaagtatactggtctgttagcagagacaaactttttttagaattgaagtctgaaacaaacaaaagcaattcaatgtcaatagacattaagcaacataatagacaaacatctcctaagggaacatttgttacagctgctccttccctgaactgtgctttggaagataagctctgtcctgagtccaaaccaagcccttccaagagagaacaaaggtcagagatgttgaagattccagcaaatttctcctcttatttctaccaagcctttgtgaacattgctcttcattttggcctgtacttctccctcagggacgtagaacaatggaatgtcagtcagtctctgtagttaaaactttttctttaaaattcaattaaggtacttctccctcagggacgtagaacaatggaatgtcagtcagtctctgtagttaaaactttttctttaaaattcaattaagttacaccagaatttacaggcaagattttttttttcattgctcccataagcaaatttgttttaaaataattgtaaatgaggtatatacttagttcttggttaaaaaatatattgctttgttaagtattaaagattatttgtaagtcattgtattaataatactaataaaatttatcaagcctttatagcaagggtcagtgaattaccactgcctgtgggccaaatctagctcactatctgtttttgtaaataaaattttataatagtacacagccacactcattcatttattttctgtggttgctttcaagctacaattgtagagttggg

SEQ ID NO: 288510 - DNA, 795 bp, Homo sapiens
catggtaaactatttgtgtattcagggagttaaaggaagacaaaggtttttaaatggggaaaaaatacaattacataattgttttgaaataattatataaagagcaataacaagggtgatgccagtctgagattggacagttactgagcagatgttcttgtagaagtcatttttgtgtaagattatgatggtctttgtgtaaggtggtggtttttgtagtttttgttatcaggcacacatcatgagaacccgctctttctggcctttcccaattctatttgtcgggtttcttaacattagtgactccatctagattctgacagttttcatgagaacttgcttttcttttctctctcaagtccttattcagtattcaacacccttaacagattagtcccactgctgagtcaggcctcttgcatgaagcagcaatgagaaagacacacttggccaatgttatcctggagtaattctcaatgatgccttctctgtgtttcttcaagacaactgtccttagtgtgagaaaatgtccagatttctcatcctctggccaatggaaggttgtcactcagagcaacggcaaggagcagagtgctgtctttgacgcagttatggtttgcagtggccaccacattctacctcatatcccactgaagtcatttccaggtgagacccgctgggattcccagctttttggagtaggtttccaggtactttatatgtagtttggattgacaagcaggattcattgctgcaactgggcagaacttggctcaataagattgagacagagct

SEQ ID NO: 288511 - DNA, 776 bp, Homo sapiens
ttcagctggaagaatgctggaggaatacggaactcctcccatttctcacagccacctccaactcttaaaaacgcttccaactgcctcccagcacacaaccaagggagaaaactattctgtcaaagagacggtgccaaaaggcaaaaacaaaggagctgatggcaaagaaggtagctgtgattggagctggggtcagtggcctaatttctctgaagtgctgtgtggatgagggacttgagcccacttgctttgagagaactgaagatattggaggagtgtggaggttcaaagagaatgtggaagatggccgagcaagtatctatcaatctgtcgttaccaacaccagcaaagaaatgtcctgtttcagtgactttccaatgcctgaagattttccaaacttcctgcataattctaaacttctggaatatttcaggatttttgctaaaaaatttgatctgctaaaatatattcagttccagacaactgtccttagtgtgagaaaatgtccagatttctcatcctctggccaatggaaggttgtcactcagagcaacggcaaggagcagagtgctgtctttgacgcagttatggtttgcagtggccaccacattctacctcatatcccactgaagtcatttccaggtatggagaggttcaaaggccaatatttccatagccgccaatacaagcatccagatggatttgagggagcttgataggattgctgttcaggttttattcgaccagcatgggacctgggtcatgagcccgtcttt

SEQ ID NO: 288512 - DNA, 3189 bp, Homo sapiens
gataatgtccatcatcatagttctctctgagggcaggctacacaagcctttgaaaactcttgtcacccaacgagcttgaagttcagcagttgggaaaatggaacctaggggctggatgagaccaatgcacgcgagggttgacttgtccaggtgagcggggaatatgtatttatacagtgagccgtatctctgaagatggctatccttgggactcagtgttccacacccggtttcgttctatgctccgcaatgtactgccacgaacagctgtaaaatggatgatagaacaacagatgaatcggtggttcaaccatgaaaattatggccttgagcctcaaaacaaatacattatgaaggaacctgtactaaatgatgatgtcccaagtcgtctactctgtggagccatcaaggtgaaatctacagtgaaagagctcacagaaacttctgccatctttgaggatggaacagtggaggagaacattgatgtcatcatttttgcaacaggatatagtttctcttttcccttccttgaagattcactcgttaaagtagagaataatatggtctcactgtataaatacatattccccgctcacctggacaagtcaaccctcgcgtgcattggtctcatccagcccctaggttccattttcccaactgctgaacttcaagctcgttgggtgacaagagttttcaaaggcttgtgtagcctgccctcagagagaactatgatgatggacattatcaaaaggaatgaaaaaagaattgacctgtttggagaaagccagagccagacgttgcagaccaattatgttgactacttggacgagctcgccttagagataggtgcgaagccagatttctgctctctcttgttcaaagatcctaaactggctgtgagactctatttcggaccctgcaactcctattagtatcgcctggttgggcctgggcaatgggaaggagccagaaatgccatcttcacccagaaacaaagaatactgaagccactcaagactcgggccctgaaggattcatctaatttctcagtttcttttctgttgaaaatcctgggccttcttgctgttgttgtggcctttttttgccaacttcaatggtcctagtcagcataatgctttgggctttattatcttgtcagtcactacctcctaaagaaaaaaaaaaaggctagaagaaaaaacattacattcatgttctaattatagattttagagttaggtagtacaggtaagggggaaattgtaaagaattagcagaattaggcatatgtacaaaaccaaaattttgtcatgaaattttgcctttccacgcttccctcagttcaccaaagttaccaaaatgtaaaataaaataagactggctcaggtaagtagtgctgccaaccctgatataggggagttgtatggaaaaatagtagaattacacagcatgaaaagcagcccatggtttaaattattggacaatttaaattgtgggtaaatatttaaaactcctgaacaatgtttctgatggtcttctatccaccctacttggtaacaaagttctcagatgttaggtcatgtttcatttgctcagtcggggatcactcaaaactactagacaaaaaagtgagaggatagatttagaaaacatcagtgatgctcagataaacttttaggacctcatattaagagctaagcaaatggccacatttcctatattttgacagagatactgctggaaaaattaaaattaaaatgccataatagctacctaacaaatatatatgtttaatgtttatcataggccagacattgtgctatgtgcatatcatatgtattatttcatttaattctcacaacaattctgtgaaatggttacagctattatagtcatttcacagatgatgaaactaagattcagagcagctgatcttgtgaggcagctggaattggaactcagatttgttgaactctagaactaaagatcataatgttgtcttgtaatatatttatttacaaaacacttcattatttataaagaatttactaacagtttatcttatttatacccatacatctgctactttgggaggccctttacatagaaaacagcattctttttgctaaatatgaccaaattacttttatttataatttttgatttatatttcagctagatctaaaaagcatctgaaggaatttacaatgaaagatacctatgcaataacatttaggataatctttgacattttggaaaaataagaattgaggaaaaaaagtgtatctttcaagtagatgcaaagcattataatgactgacacttgtatctaactccagtcttacagataactaaggcaaaaagctaaataaacaatatgtaacctctaacatttggtaaaaggaagtatactggtctgttagcagagacaaactttttttagaattgaagtctgaaacaaacaaaagcaattcaatgtcaatagacattaagcaacataatagacaaacatctcctaagggaacatttgttacagctgctccttccctgaactgtgctttggaagataagctctgtcctgagtccaaaccaagcccttccaagagagaacaaaggtcagagatgttgaagattccagcaaatttctcctcttatttctaccaagcctttgtgaacattgctcttcattttggcctgtacttctccctcagggacgtagaacaatggaatgtcagtcagtctctgtagttaaaactttttctttaaaattcaattaaggtacttctccctcagggacgtagaacaatggaatgtcagtcagtctctgtagttaaaactttttctttaaaattcaattaagttacaccagaatttacaggcaagattttttttttcattgctcccataagcaaatttgttttaaaataattgtaaatgaggtatatacttagttcttggttaaaaaatatattgctttgttaagtattaaagattatttgtaagtcattgtattaataatactaataaaatttatcaagcctttatagcaagggtcagtgaattaccactgcctgtgggccaaatctagctcactatctgtttttgtaaataaaattttataatagtacacagccacactcattcatttattttctgtggttgctttcaagctacaattgtagagttggg

SEQ ID NO: 288513 - DNA, 978 bp, Homo sapiens
ggcgggggggggccgggccgggccgggccgggccgggggcgcgcgctctgcgagctggatgtccaggctgcgggcgctgctgggcctcgggctgctggttgcgggctcgcgcctgccgcggatcaaaagccagaccatcgcctgtcgctcgggacccacctggtggggaccgcagcggctgaactcgggtggccgctgggactcagaggtcatggcgagcacggtggtgaagtacctgagccaggaggaggcccaggccgtggaccaggagctatttaacgaataccagttcagcgtggaccaacttatggaactggccgggctgagctgtgctacagccatcgccaaggcatatccccccacgtccatgtccaggagcccccctactgtcctggtcatctgtggcccggggaataatggaggagatggtctggtctgtgctcgacacctcaaactctttggctacgagccaaccatctattaccccaaaaggcctaacaagcccctcttcactgcattggtgacccagtgtcagaaaatggacatccctttccttggggaaatgcccgcagagcccatgacgattgatgaactgtatgagctggtggtggatgccatctttggcttcagcttcaagggcgatgttcgggaaccgttccacagcatcctgagtgtcctgaagggactcactgtgcccattgccagcatcgacattccctcaggatgggacgtggagaagggaaatgctggagggatccagccagacttgctcatctccctcacagcccccaaaaaatctgcaacccagtttaccggtcgctaccattacctggggggtcgttttgtgccacctgctctggaaaagaagtaccagctgaacctgccaccctaccctgacactgagtgtgtctatcgtctgcagtgagggaaggtgggtgggtattctccccaataaagacttagagcccctctcttcca

SEQ ID NO: 288514 - DNA, 1427 bp, Homo sapiens
ggcgggggggggccgggccgggccgggccgggccgggggcgcgcgctctgcgagctggatgtccaggctgcgggcgctgctgggcctcgggctgctggttgcgggctcgcgcctgccgcggatcaaaagccagaccatcgcctgtcgctcgggacccacctggtggggaccgcagcggctgaactcgggtggccgctgggactcagaggtcatggcgagcacggtggtgaagtacctgagccaggaggaggcccaggccgtggaccaggagctatttaacgaataccagttcagcgtggaccaacttatggaactggccgggctgagctgtgctacagccatcgccaaggcatatccccccacgtccatgtccaggagcccccctactgtcctggtcatctgtggcccggggaataatggaggagatggtctggtctgtgctcgacacctcaaactctttggctacgagccaaccatctattaccccaaaaggcctaacaagcccctcttcactgcattggtgacccagtgtcagaaaatggacatccctttccttggggaaatgcccgcagagcccatgacgattgatgaactgtatgagctggtggtggatgccatctttggcttcagcttcaagggcgatgttcgggaaccgttccacagcatcctgagtgtcctgaagggactcactgtgcccattgccagcatcgacattccctcaggatgggacgtggagaagggaaatgctggagggatccagccagacttgctcatctccctcacagcccccaaaaaatctgcaacccagtttaccggtcgctaccattacctggggggtcgttttgtgccacctgctctggaaaagaagtaccagctgaacctgccaccctaccctgacactgagtgtgtctatcgtctgcagtgagggaaggtgggtgggtattctccccaataaagacttagagcccctctcttccagaactgtggattcctgggagctcctctggcaataaaagtcagtgaatggtggaagtcagagagcaaccctggggattgggtgccatctctctaggggtaacacaaagggcaagaggttgctatggtatttggaaacaatgaaaatggactgttagatgccaaaaaaaaaaaaaaaaaaaaaaaaaaaaatttttgggccccttgggccctgcaaaaagtttttaagaaccatttgctttggggccccgggggccccatgtgggttactggtgaccctggcgctcatacgcgtgttccctagggaagaacccgggccagagcattagttgctgggtttctcgcctattaaacacgccccgggggaccggggtgtttttgcacaatccccgagcgcgtccggaggccatagggggtctacacgcggggtcccaggaactcatctatgcccg

SEQ ID NO: 288515 - DNA, 1436 bp, Homo sapiens
cttcgtgctagcgtcgaggctcgtttgtattcgcgcgacgtacgggggcgcgcgctctgcgagctggatgtccaggctgcgggcgctgctgggcctcgggctgctggttgcgggctcgcgcctgccgcggatcaaaagccagaccatcgcctgtcgctcgggacccacctggtggggaccgcagcggctgaactcgggtggccgctgggactcagaggtcatggcgagcacggtggtgaagtacctgagccaggaggaggcccaggccgtggaccaggagctatttaacgaataccagttcagcgtggaccaacttatggaactggccgggctgagctgtgctacagccatcgccaaggcatatccccccacgtccatgtccaggagcccccctactgtcctggtcatctgtggcccggggaataatggaggagatggtctggtctgtgctcgacacctcaaactctttggctacgagccaaccatctattaccccaaaaggcctaacaagcccctcttcactgcattggtgacccagtgtcagaaaatggacatccctttccttggggaaatgcccgcagagcccatgacgattgatgaactgtatgagctggtggtggatgccatctttggcttcagcttcaagggcgatgttcgggaaccgttccacagcatcctgagtgtcctgaagggactcactgtgcccattgccagcatcgacattccctcaggatgggacgtggagaagggaaatgctggagggatccagccagacttgctcatctccctcacagcccccaaaaaatctgcaacccagtttaccggtcgctaccattacctggggggtcgttttgtgccacctgctctggaaaagaagtaccagctgaacctgccaccctaccctgacactgagtgtgtctatcgtctgcagtgagggaaggtgggtgggtattctccccaataaagacttagagcccctctcttccagaactgtggattcctgggagctcctctggcaataaaagtcagtgaatggtggaagtcagagagcaaccctggggattgggtgccatctctctaggggtaacacaaagggcaagaggttgctatggtatttggaaacaatgaaaatggactgttagatgccaaaaaaaaaaaaaaaaaaaaaaaaaaaaatttttgggccccttgggccctgcaaaaagtttttaagaaccatttgctttggggccccgggggccccatgtgggttactggtgaccctggcgctcatacgcgtgttccctagggaagaacccgggccagagcattagttgctgggtttctcgcctattaaacacgccccgggggaccggggtgtttttgcacaatccccgagcgcgtccggaggccatagggggtctacacgcggggtcccaggaactcatctatgcccg

SEQ ID NO: 288516 - DNA, 1028 bp, Homo sapiens
ctgctctggagaagaagtaccagctgaacctgccaccctaccctgacacctcaaactctttggctacgagccaaccatctattaccccaaaaggcctaacaagcccctcttcactgcattggtgacccagtgtcagaaaatggacatccctttccttggggaaatgcccgcagagcccatgacgattgatgaactgtatgagctggtggtggatgccatctttggcttcagcttcaagggcgatgttcgggaaccgttccacagcatcctgagtgtcctgaagggactcactgtgcccattgccagcatcgacattccctcaggatgggacgtggagaagggaaatgctggagggatccagccagacttgctcatctccctcacagcccccaaaaaatctgcaacccagtttaccggtcgctaccattacctggggggtcgttttgtgccacctgctctggaaaagaagtaccagctgaacctgccaccctaccctgacactgagtgtgtctatcgtctgcagtgagggaaggtgggtgggtattctccccaataaagacttagagcccctctcttccagaactgtggattcctgggagctcctctggcaataaaagtcagtgaatggtggaagtcagagagcaaccctggggattgggtgccatctctctaggggtaacacaaagggcaagaggttgctatggtatttggaaacaatgaaaatggactgttagatgccaaaaaaaaaaaaaaaaaaaaaaaaaaaaatttttgggccccttgggccctgcaaaaagtttttaagaaccatttgctttggggccccgggggccccatgtgggttactggtgaccctggcgctcatacgcgtgttccctagggaagaacccgggccagagcattagttgctgggtttctcgcctattaaacacgccccgggggaccggggtgtttttgcacaatccccgagcgcgtccggaggccatagggggtctacacgcggggtcccaggaactcatctatgcccg

SEQ ID NO: 288517 - DNA, 1380 bp, Homo sapiens
cttcgtgctagcgtcgaggctcgtttgtattcgcgcgacgtacgggggcgcgcgctctgcgagctggatgtccaggctgcgggcgctgctgggcctcgggctgctggttgcgggctcgcgcctgccgcggatcaaaagccagaccatcgcctgtcgctcgggacccacctggtggggaccgcagcggctgaactcgggtggccgctgggactcagaggtcatggcgagcacggtggtgaagtacctgagccaggaggaggcccaggccgtggaccaggagctatttaacgaataccagttcagcgtggaccaacttatggaactggccgggctgagctgtgctacagccatcgccaaggcatatccccccacgtccatgtccaggagcccccctactgtcctggtcatctgtggcccggggaataatggaggagatggtctggtctgtgctcgacacctcaaactctttggctacgagccaaccatctattaccccaaaaggcctaacaagcccctcttcactgcattggtgacccagtgtcagaaaatggacatccctttccttggggaaatgcccgcagagcttcaagggcgatgttcgggaaccgttccacagcatcctgagtgtcctgaagggactcactgtgcccattgccagcatcgacattccctcaggatgggacgtggagaagggaaatgctggagggatccagccagacttgctcatctccctcacagcccccaaaaaatctgcaacccagtttaccggtcgctaccattacctggggggtcgttttgtgccacctgctctggaaaagaagtaccagctgaacctgccaccctaccctgacactgagtgtgtctatcgtctgcagtgagggaaggtgggtgggtattctccccaataaagacttagagcccctctcttccagaactgtggattcctgggagctcctctggcaataaaagtcagtgaatggtggaagtcagagagcaaccctggggattgggtgccatctctctaggggtaacacaaagggcaagaggttgctatggtatttggaaacaatgaaaatggactgttagatgccaaaaaaaaaaaaaaaaaaaaaaaaaaaaatttttgggccccttgggccctgcaaaaagtttttaagaaccatttgctttggggccccgggggccccatgtgggttactggtgaccctggcgctcatacgcgtgttccctagggaagaacccgggccagagcattagttgctgggtttctcgcctattaaacacgccccgggggaccggggtgtttttgcacaatccccgagcgcgtccggaggccatagggggtctacacgcggggtcccaggaactcatctatgcccg

SEQ ID NO: 288518 - DNA, 1311 bp, Homo sapiens
cttcgtgctagcgtcgaggctcgtttgtattcgcgcgacgtacgggggcgcgcgctctgcgagctggatgtccaggctgcgggcgctgctgggcctcgggctgctggttgcgggctcgcgcctgccgcggatcaaaagccagaccatcgcctgtcgctcgggacccacctggtggggaccgcagcggctgaactcgggtggccgctgggactcagaggtcatggcgagcacggtggtgaagtacctgagccaggaggaggcccaggccgtggaccaggagctatttaacgaataccagttcagcgtggaccaacttatggaactggccgggctgagctgtgctacagccatcgccaaggcatatccccccacgtccatgtccaggagcccccctactgtcctggtcatctgtggcccggggaataatggaggagatggtctggtctgtgctcgacacctcaaactctttggctacgagccaaccatctattaccccaaaaggcctaacaagcccctcttcactgcattggtgacccagtgtcagaaaatggacatccctttccttggggaaatgcccgcagagcccatgacgattgatgaactgtatgagctggtggtggatgccatctttggcttcagcttcaagggcgatgttcgggaaccgttccacagcatcctgagtgtcctgaagggactcactgtgcccattgccagcatcgacattccctcaggctgggatccagaaggtggggtgggagagattggggccctaccctcctgactcttgcccacaccaggtctaaaataattttagtctagaggggcagaacacagctttctggacccccatcagggctggggaacagtgttcagaagtcccctttacatgttggccccatgaagagaccacggcccaagggtacgtggagctcgttggacgagagttcctcaggtgggaactgaggggacttcccactcctctgggactagggtaaactaaggtgtagaaggggacgagacatctggcctcttcctgaacaccaccctcttttcaggatgggacgtggagaagggaaatgctggagggatccagccagacttgctcatctccctcacagcccccaaaaaatctgcaacccagtttaccggtcgctaccattacctggggggtcgttttgtgccacctgctctggaaaagaagtaccagctgaacctgccaccctaccctgacactgagtgtgtctatcgtctgcagtgagggaaggtgggtgggtattctccccaataaagacttagagcccctctcttcca

SEQ ID NO: 288519 - DNA, 937 bp, Homo sapiens
cttcgtgctagcgtcgaggctcgtttgtattcgcgcgacgtacgggggcgcgcgctctgcgagctggatgtccaggctgcgggcgctgctgggcctcgggctgctggttgcgggctcgcgcctgccgcggatcaaaagccagaccatcgcctgtcgctcgggacccacctggtggggaccgcagcggctgaactcgggtggccgctgggactcagaggtcatggcgagcacggtggtgaagtacctgagccaggaggaggcccaggccgtggaccaggagctatttaacgaataccagttcagcgtggaccaacttatggaactggccgggctgagctgtgctacagccatcgccaaggcatatccccccacgtccatgtccaggagcccccctactgtcctggtcatctgtggcccggggaataatggaggagatggtctggtctgtgctcgacacctcaaactctttggctacgagccaaccatctattaccccaaaaggcctaacaagcccctcttcactgcattggtgacccagtgtcagaaaatggacatccctttccttggggaaatgcccgcagaggtaggtggctccagttgaatacctccatcctacagtaaccactgcctgtgctctgctcttccttcgtgtttccaggctgagctcattttagtgcctggtacggaaggtgcctaacggatggtattcgaataagtgtgcaagagccttctcctccttcataaagtgtgctccatgagtcccacacaccaccttctctaaagcttccttgccctttcatctccctggtccctccttccactctgtagtcagatcctcttgccctagcatgcagtaaacacatgatctacccctcaggggccggagtggctgccctatctgaaacccttcctgcagatgcatggattaagggatggg

SEQ ID NO: 288520 - DNA, 537 bp, Homo sapiens
tcaggctgccctctgaatgagacacaatacttgtgcctctgagaatggtctgcaggtgcagaggacagccctctccagttaaggctgtttgtgcagctgctggctctgacatccttttcctgctccaccacagcccatgacgattgatgaactgtatgagctggtggtggatgccatctttggcttcagcttcaagggcgatgttcgggaaccgttccacagcatcctgagtgtcctgaagggactcactgtgcccattgccagcatcgacattccctcaggatgggacgtggagaagggaaatgctggagggatccagccagacttgctcatctccctcacagcccccaaaaaatctgcaacccagtttaccggtcgctaccattacctggggggtcgttttgtgccacctgctctggaaaagaagtaccagctgaacctgccaccctaccctgacactgagtgtgtctatcgtctgcagtgagggaaggtgggtgggtattctccccaataaagacttagagcccctctcttcca

SEQ ID NO: 288521 - DNA, 866 bp, Homo sapiens
ggcgggggggggccgggccgggccgggccgggccgggggcgcgcgctctgcgagctggatgtccaggctgcgggcgctgctgggcctcgggctgctggttgcgggctcgcgcctgccgcggatcaaaagccagaccatcgcctgtcgctcgggacccacctggtggggaccgcagcggctgaactcgggtggccgctgggactcagaggtcatggcgagcacggtggtgaagtacctgagccaggaggaggcccaggccgtggaccaggagctatttaacgaataccagttcagcgtggaccaacttatggaactggccgggctgagctgtgctacagccatcgccaaggcatatccccccacgtccatgtccaggagcccccctactgtcctggtcatctgtggcccggggaataatggaggagatggtctggtctgtgctcgacacctcaaactctttggctacgagccaaccatctattaccccaaaaggcctaacaagcccctcttcactgcattggtgacccagtgtcagaaaatggacatccctttccttggggaaatgcccgcagagcccatgacgattgatgaactgtatgagctggtggtggatgccatctttggcttcagcttcaagggcgatgttcgggaaccgttccacagcatcctgagtgtcctgaagggactcactgtgcccattgccagcatcgacattccctcaggatgggacgtggagaagggaaatgctggagggatccagccagacttgctcatctccctcacagcccccaaaaaatctgcaacccagtttaccggtcgctaccattacctgtcggctaactcggggggcatcctctaagtcacct

SEQ ID NO: 288522 - DNA, 1301 bp, Homo sapiens
cttcgtgctagcgtcgaggctcgtttgtattcgcgcgacgtacgggggcgcgcgctctgcgagctggatgtccaggctgcgggcgctgctgggcctcgggctgctggttgcgggctcgcgcctgccgcggatcaaaagccagaccatcgcctgtcgctcgggacccacctggtggggaccgcagcggctgaactcgggtggccgctgggactcagaggtcatggcgagcacggtggtgaagtacctgagccaggaggaggcccaggccgtggaccaggagctatttaacgaataccagttcagcgtggaccaacttatggaactggccgggctgagctgtgctacagccatcgccaagcccaaaaggcctaacaagcccctcttcactgcattggtgacccagtgtcagaaaatggacatccctttccttggggaaatgcccgcagagcccatgacgattgatgaactgtatgagctggtggtggatgccatctttggcttcagcttcaagggcgatgttcgggaaccgttccacagcatcctgagtgtcctgaagggactcactgtgcccattgccagcatcgacattccctcaggatgggacgtggagaagggaaatgctggagggatccagccagacttgctcatctccctcacagcccccaaaaaatctgcaacccagtttaccggtcgctaccattacctggggggtcgttttgtgccacctgctctggaaaagaagtaccagctgaacctgccaccctaccctgacactgagtgtgtctatcgtctgcagtgagggaaggtgggtgggtattctccccaataaagacttagagcccctctcttccagaactgtggattcctgggagctcctctggcaataaaagtcagtgaatggtggaagtcagagagcaaccctggggattgggtgccatctctctaggggtaacacaaagggcaagaggttgctatggtatttggaaacaatgaaaatggactgttagatgccaaaaaaaaaaaaaaaaaaaaaaaaaaaaatttttgggccccttgggccctgcaaaaagtttttaagaaccatttgctttggggccccgggggccccatgtgggttactggtgaccctggcgctcatacgcgtgttccctagggaagaacccgggccagagcattagttgctgggtttctcgcctattaaacacgccccgggggaccggggtgtttttgcacaatccccgagcgcgtccggaggccatagggggtctacacgcggggtcccaggaactcatctatgcccg

SEQ ID NO: 288523 - DNA, 1760 bp, Homo sapiens
cttcgtgctagcgtcgaggctcgtttgtattcgcgcgacgtacgggggcgcgcgctctgcgagctggatgtccaggctgcgggcgctgctgggcctcgggctgctggttgcgggctcgcgcctgccgcggatcaaaagccagaccatcgcctgtcgctcgggacccacctggtggggaccgcagcggctgaactcgggtggccgctgggactcagaggtcatggcgagcacggtggtgaagtacctgagccaggaggaggcccaggccgtggaccaggagctatttaacgaataccagttcagcgtggaccaacttatggaactggccgggctgagctgtgctacagccatcgccaaggcatatccccccacgtccatgtccaggagcccccctactgtcctggtcatctgtggcccggggaataatggaggagatggtctggtctgtgctcgacacctcaaactctttggctacgagccaaccatctattaccccaaaaggcctaacaagcccctcttcactgcattggtgacccagtgtcagaaaatggacatccctttccttggggaaatgcccgcagagcccatgacgattgatgaactgtatgagctggtggtggatgccatctttggcttcagcttcaagggcgatgttcgggaaccgttccacagcatcctgagtgtcctgaagggactcactgtgcccattgccagcatcgacattccctcaggctgggatccagaaggtggggtgggagagattggggccctaccctcctgactcttgcccacaccaggtctaaaataattttagtctagaggggcagaacacagctttctggacccccatcagggctggggaacagtgttcagaagtcccctttacatgttggccccatgaagagaccacggcccaagggtacgtggagctcgttggacgagagttcctcaggtgggaactgaggggacttcccactcctctgggactagggtaaactaaggtgtagaaggggacgagacatctggcctcttcctgaacaccaccctcttttcaggatgggacgtggagaagggaaatgctggagggatccagccagacttgctcatctccctcacagcccccaaaaaatctgcaacccagtttaccggtcgctaccattacctggggggtcgttttgtgccacctgctctggaaaagaagtaccagctgaacctgccaccctaccctgacactgagtgtgtctatcgtctgcagtgagggaaggtgggtgggtattctccccaataaagacttagagcccctctcttccagaactgtggattcctgggagctcctctggcaataaaagtcagtgaatggtggaagtcagagagcaaccctggggattgggtgccatctctctaggggtaacacaaagggcaagaggttgctatggtatttggaaacaatgaaaatggactgttagatgccaaaaaaaaaaaaaaaaaaaaaaaaaaaaatttttgggccccttgggccctgcaaaaagtttttaagaaccatttgctttggggccccgggggccccatgtgggttactggtgaccctggcgctcatacgcgtgttccctagggaagaacccgggccagagcattagttgctgggtttctcgcctattaaacacgccccgggggaccggggtgtttttgcacaatccccgagcgcgtccggaggccatagggggtctacacgcggggtcccaggaactcatctatgcccg

SEQ ID NO: 288524 - DNA, 313 bp, Homo sapiens
gcacaactctcgacctttgggagcagccagggaggagtcactgtcccagccccctggcctaggcacaaaggggtgggagagacagctgggccaatatggtctattaccgcctgaaaccccgccgaaccacccttgactctgccttcaggcatatccccccacgtccatgtccaggagcccccctactgtcctggtcatctgtggcccggggaataatggaggagatggtctggtctgtgctcgacacctcaaactctttgtgagtatgtggggaggggctgtgggggaggagggcgtgagggctctgggatct

SEQ ID NO: 288525 - DNA, 1147 bp, Homo sapiens
cggcctttcgaggggaaacatcgcttcacgggcagaaggcatgtaggccaagtaggcgaaggaaacgcacgcgaactgtctaccgtctacgtccaccgatccaagactctcgccatgtcacctcgccccagaaagtgtctgcaaaggacacgcaaccacgctcactcagcgccgggccctatttccttctccacagccggttttccccgaagactataaaatgcgaacctcttccggctgtggaacatggcggcgcccgtggaaaggaccacatttgggggcggggcctggcggtacttccgtccaggtccagcgggtgctgtgatcttcaagtatggggtctgctggcttgtcgcggctgcatgggcttttcgcggtctataagcccccggggctaaaatggaagcacctgcgggatacagtggagctacaacttctgaagggtctcaatgccaggaagcctcccgctcctaaacagcgtgttcgcttcttgctgggccccatggaaggcagcgaagagaaggagctgaccctcacagccaccagcgtaccctctttcatcaaccatccactggtatgtggaccagcattcgcccatctcaaggttggcgtgggacatcggttggatgcccaggcttctggagtacttgtgctcggcgtgggacatggatgcaggctcctcaccgatatgtacaatgctcatcttaccaaggattacacagtgcgtggcctcctgggcaaagctacagatgacttccgtgaggacgggaggctggtagagaagacaacctatgaccacgtgaccagagagaagctggaccgcattctggccgttatccaaggctcccatcagaaggccctggtgatgtactccaacctcgacctgaagacccaggaggcctatgagatggccgtgagaggcctgatccggcccatgaacaagtccccgatgctgataactggcatccgatgcctctactttgcacctccggaattcctcttagagggggccgcatggtgggacaccgacaagggtgcggaatgggccaggaaaaggcgcggaaaaagacccggttgtgggcccccaggggggcacccgagggtttacccaaaagggcccctggccggggctcccacacacgggtcg

SEQ ID NO: 288526 - DNA, 671 bp, Homo sapiens
gcagaatccaatgaaatggtgaggaaagctgggtgggagtggagggtatcagcaaaactcagttctttggaaaaattaggtaacttgaacgtagggcacatgggctgtcacaccaccccatttagagcccttattggcatagagatgataaaagtggactctgtgatggcctctcatgatctcaggatagcaggataggggaactctgagtcatggccaaaataattggtcaatgtacagcctcagacagctgggaataccaccccaaatcacttggataaggagatgttttccttatcctgtgtctttaactctgagacggatggagttgaacaatcaacgattgttaaaaatgtaccaaatgtgtaagcatcatgaggtgtttaagctgagcttttaaattaaaattctgctgggtgtggcggctcatgcctgtaatcccagcactttgcgatccccacacaggaggattgcttgagcccagaagttttagacggcgcctgtgaatagccactgcactctagtctggggaacatatgagacccctgccatctcaaaaaaaaaaaaatttttcaataaattatgtgcccacgaaatttaaatttaaaaaattgggttttggcgggtctttaccagggtaatttcatggtttacagagagccttaaaagaa

SEQ ID NO: 288527 - DNA, 1662 bp, Homo sapiens
cggcctttcgaggggaaacatcgcttcacgggcagaaggcatgtaggccaagtaggcgaaggaaacgcacgcgaactgtctaccgtctacgtccaccgatccaagactctcgccatgtcacctcgccccagaaagtgtctgcaaaggacacgcaaccacgctcactcagcgccgggccctatttccttctccacagccggttttccccgaagactataaaatgcgaacctcttccggctgtggaacatggcggcgcccgtggaaaggaccacatttgggggcggggcctggcggtacttccgtccaggtccagcgggtgctgtgatcttcaagtatggggtctgctggcttgtcgcggctgcatgggcttttcgcggtctataagcccccggggctaaaatggaagcacctgcgggatacagtggagctacaacttctgaagggtctcaatgccaggaagcctcccgctcctaaacagcgtgttcgcttcttgctgggccccatggaaggcagcgaagagaaggagctgaccctcacagccaccagcgtaccctctttcatcaaccatccactggtatgtggaccagcattcgcccatctcaaggttggcgtgggacatcggttggatgcccaggcttctggagtacttgtgctcggcgtgggacatggatgcaggctcctcaccgatatgtacaatgctcatcttaccaaggattacacagtgcgtggcctcctgggcaaagctacagatgacttccgtgaggacgggaggctggtagagaagacaacctatgaccacgtgaccagagagaagctggaccgcattctggccgttatccaaggctcccatcagaaggccctggtgatgtactccaacctcgacctgaagacccaggaggcctatgagatggccgtgagaggcctgatccggcccatgaacaagtccccgatgctgataactggcatccgatgcctctactttgcacctccggaattcctcttagaggtgcagtgcatgcatgagacgcagaaagagctgcggaagttggttcatgaaatcggcctggaactaaagaccactgctgtctgcacccaagtgcggcgcacgcgcgacggcttcttcacgctagacagtgccctcctgaggacccagtgggacctaaccaacatccaggatgctatccgggctgctacccctcaggtagctgcagagctggagaagagcttgagcccggggctggacaccaagcagctccccagtccgggatggtcctgggactcccagggcccgagctctaccttggggctggagaggggtgcggggcagtgaatgcccaggcagctcctggggcagtggatggataaatagaagaactgctatgagctggacctgatagctgtgcagaaagtgagagcaggggcaccttttctacgtaagacacaaaactcaagctgtaacagaaaggtcaatggacttgacccaactgagaaggatggcagaccaggcgtggtggcgggcacttgtaatcccagctactcccaaggctgaggcaggagaattgcttgagcccaggagtttaaggttgtagtgcgctagacggcgcctgtgaatagccactgcactctagtctggggaacatatgagacccctgccatctcaaa

SEQ ID NO: 288528 - DNA, 1641 bp, Homo sapiens
cggcctttcgaggggaaacatcgcttcacgggcagaaggcatgtaggccaagtaggcgaaggaaacgcacgcgaactgtctaccgtctacgtccaccgatccaagactctcgccatgtcacctcgccccagaaagtgtctgcaaaggacacgcaaccacgctcactcagcgccgggccctatttccttctccacagccggttttccccgaagactataaaatgcgaacctcttccggctgtggaacatggcggcgcccgtggaaaggaccacatttgggggcggggcctggcggtacttccgtccaggtccagcgggtgctgtgatcttcaagtatggggtctgctggcttgtcgcggctgcatgggcttttcgcggtctataagcccccggggctaaaatggaagcacctgcgggatacagtggagctacaacttctgaagggtctcaatgccaggaagcctcccgctcctaaacagcgtgttcgcttcttgctgggccccatggaaggcagcgaagagaaggagctgaccctcacagccaccagcgtaccctctttcatcaaccatccactggtgctcggcgtgggacatggatgcaggctcctcaccgatatgtacaatgctcatcttaccaaggattacacagtgcgtggcctcctgggcaaagctacagatgacttccgtgaggacgggaggctggtagagaagacaacctatgaccacgtgaccagagagaagctggaccgcattctggccgttatccaaggctcccatcagaaggccctggtgatgtactccaacctcgacctgaagacccaggaggcctatgagatggccgtgagaggcctgatccggcccatgaacaagtccccgatgctgataactggcatccgatgcctctactttgcacctccggaattcctcttagaggtgcagtgcatgcatgagacgcagaaagagctgcggaagttggttcatgaaatcggcctggaactaaagaccactgctgtctgcacccaagtgcggcgcacgcgcgacggcttcttcacgctagacagtgccctcctgaggacccagtgggacctaaccaacatccaggatgctatccgggctgctacccctcaggtagctgcagagctggagaagagcttgagcccggggctggacaccaagcagctccccagtccgggatggtcctgggactcccagggcccgagctctaccttggggctggagaggggtgcggggcagtgaatgcccaggcagctcctggggcagtggatggataaatagaagaactgctatgagctggacctgatagctgtgcagaaagtgagagcaggggcaccttttctacgtaagacacaaaactcaagctgtaacagaaaggtcaatggacttgacccaactgagaaggaaaaacttctgtatggaggaaaagacagtaaacatgacagactgatagaaagtattggcagaccaggcgtggtggcgggcacttgtaatcccagctactcccaaggctgaggcaggagaattgcttgagcccaggagtttaaggttgtagtgcgctagacggcgcctgtgaatagccactgcactctagtctggggaacatatgagacccctgccatctcaaa

SEQ ID NO: 288529 - DNA, 1180 bp, Homo sapiens
ttggccaacgggaggccaagaagagcaagagaaccaagctgtcctgctgagagtatatgatctaatggcaaggaaaccagggaccacatcattggagcacagagcccaagggcaagagcagccaaggagttaagagcttgggctctggagccagcttgcctgggtttcctgactctaccaggcacctggtgatgaaggagggcaggaaaggtggctggaggagccacggtggcagggcacacaaagcaagtgaggagcttccagagaggcacctcatgtgggggaaagggtaggtgggccacccagctgcagcccccttcctgatctgcaggtactccaacctcgacctgaagacccaggaggcctatgagatggccgtgagaggcctgatccggcccatgaacaagtccccgatgctgataactggcatccgatgcctctactttgcacctccggaattcctcttagaggtgcagtgcatgcatgagacgcagaaagagctgcggaagttggttcatgaaatcggcctggaactaaagaccactgctgtctgcacccaagtgcggcgcacgcgcgacggcttcttcacgctagacagtgccctcctgaggacccagtgggacctaaccaacatccaggatgctatccgggctgctacccctcaggtagctgcagagctggagaagagcttgagcccggggctggacaccaagcagctccccagtccgggatggtcctgggactcccagggcccgagctctaccttggggctggagaggggtgcggggcagtgaatgcccaggcagctcctggggcagtggatggataaatagaagaactgctatgagctggacctgatagctgtgcagaaagtgagagcaggggcaccttttctacgtaagacacaaaactcaagctgtaacagaaaggtcaatggacttgacccaactgagaaggaaaaacttctgtatggaggaaaagacagtaaacatgacagactgatagaaagtattggcagaccaggcgtggtggcgggcacttgtaatcccagctactcccaaggctgaggcaggagaattgcttgagcccaggagtttaaggttgtagtgcgctagacggcgcctgtgaatagccactgcactctagtctggggaacatatgagacccctgccatctcaaa

SEQ ID NO: 288530 - DNA, 1736 bp, Homo sapiens
gcagaatccaatgaaatggtgaggaaagctgggtgggagtggagggtatcagcaaaactcagttctttggaaaaattaggtaacttgaacgtagggcacatgggctgtcacaccaccccatttagagcccttattggcatagagatgataaaagtggactctgtgatggcctctcatgatctcaggatagcaggataggggaactctgagtcatggccaaaataattggtcaatgtacagcctcagacagctgggaataccaccccaaatcacttggataaggagatgttttccttatcctgtgtctttaactctgagacggatggagttgaacaatcaacgattgttaaaaatgtaccaaatgtgtaagcatcatgaggtgtttaagctgagcttttaaattaaaattctgctgggtgtggcggctcatgcctgtaatcccagcactttgcgatccccacacaggaggattgcttgagcccagaagtttgagaccagcctgggcaacacaaggagaccctgtctctacaaaaaacaaacaaacaaacaaaaaagccgggggtgttggtgtgtgcctgtagtcccagctactagggaggctgagatgggaggatcgcttgaacctagcaagtcaaggcggcagtaaatggagatctgtactccagcctgggcaacagagcgagaccctatgtcagaaaaaaagaaaaagccacccagcaggctgagcgtggtggctcacgcctgtaatccctgcactttgggaagccaaagcaggtgaatcacttgaggtcaggagttcgagaccagcctggccaatatggtgaaaccctgtctctaccaaaaatacaaaaattagccgggcatggtggcgcttgtctgtagtccagctacagctactccagatctgggctgaggtgggagaatcatttgaacccaggaggtggaggttgcagtgagctgaaatcacacgactgtactctagcctgggtgacagggtgagaccctatctcaaaacaaacaaacaaaaaccccaccagcaaccttgctgacaaatccacaggcccccacgtctgccaattgcctgcctgtatgaactgggcacctgggggaggggcgtggcccccaggctactcatcttggctttcacagccaaagggcctgggtggaacctcagcttactgtgtttactgactgggtaatgtggcctctgaagctgtcacctatctataaaatggggattaaaacgacactcacttgctcattgtctttcatcccacccacgtgtgttaatcgcgtgctcctgtaggccagccactgctctgggtgctgggacttggtactcaaggacagatgaggctctaggtctcacagagattatgacgtagggggatcaggcaagaaaataatggagtgatgagcacagggaggagatctggctggtcagtgaagcagaggcttgggagctgattcattttatatataagtatgtacgtaatttttttttttttttgagacagagtctcactttgtcacctaggctggagtgtagtggcgctagacggcgcctgtgaatagccactgcactctagtctggggaacatatgagacccctgccatctcaaaaaaaaaaaaatttttcaataaattatgtgcccacgaaatttaaatttaaaaaattgggttttggcgggtctttaccagggtaatttcatggtttacagagagccttaaaagaa

SEQ ID NO: 288531 - DNA, 1160 bp, Homo sapiens
tttttttctgagacggagtctcactccgtcatccaggttggagtgcagtggcacaatctcagctcactgcaacctctgcctcccaggttcaagcgattctcctgcctcagcttctcaagtagctgggattacagatgtgtaccaccatgcctggctaatttttgtatttttagtagagacagggtttcaccatgttggccaggctggtctggaactcctgacctcaggtgatccgcccacctcagcctcccagagcgctgggattatgccaacctctgcctcccaaagcactgggatggcaggcatgagccaccacacccggcctgtttttgttttttagacagggtcttgctctgtcacccaggctggagttgcagtgagctgaaatcacacgactgtactctagcctgggtgacagggtgagaccctatctcaaaacaaacaaacaaaaaccccaccagcaaccttgctgacaaatccacaggcccccacgtctgccaattgcctgcctgtatgaactgggcacctgggggaggggcgtggcccccaggctactcatcttggctttcacagccaaagggcctgggtggaacctcagcttactgtgtttactgactgggtaatgtggcctctgaagctgtcacctatctataaaatggggattaaaacgacactcacttgctcattgtctttcatcccacccacgtgtgttaatcgcgtgctcctgtaggccagccactgctctgggtgctgggacttggtactcaaggacagatgaggctctaggtctcacagagattatgacgtagggggatcaggcaagaaaataatggagtgatgagcacagggaggagatctggctggtcagtgaagcagaggcttgggagctgattcattttatatataagtatgtacgtaatttttttttttttttgagacagagtctcactttgtcacctaggctggagtgtagtggcgctagacggcgcctgtgaatagccactgcactctagtctggggaacatatgagacccctgccatctcaaaaaaaaaaaaatttttcaataaattatgtgcccacgaaatttaaatttaaaaaattgggttttggcgggtctttaccagggtaatttcatggtttacagagagccttaaaagaa

SEQ ID NO: 288532 - DNA, 840 bp, Homo sapiens
gatgaaaatgagatgatttttgttgtttttctgttgttgcccaggctggagttgcagtgagctgaaatcacacgactgtactctagcctgggtgacagggtgagaccctatctcaaaacaaacaaacaaaaaccccaccagcaaccttgctgacaaatccacaggcccccacgtctgccaattgcctgcctgtatgaactgggcacctgggggaggggcgtggcccccaggctactcatcttggctttcacagccaaagggcctgggtggaacctcagcttactgtgtttactgactgggtaatgtggcctctgaagctgtcacctatctataaaatggggattaaaacgacactcacttgctcattgtctttcatcccacccacgtgtgttaatcgcgtgctcctgtaggccagccactgctctgggtgctgggacttggtactcaaggacagatgaggctctaggtctcacagagattatgacgtagggggatcaggcaagaaaataatggagtgatgagcacagggaggagatctggctggtcagtgaagcagaggcttgggagctgattcattttatatataagtatgtacgtaatttttttttttttttgagacagagtctcactttgtcacctaggctggagtgtagtggcgctagacggcgcctgtgaatagccactgcactctagtctggggaacatatgagacccctgccatctcaaaaaaaaaaaaatttttcaataaattatgtgcccacgaaatttaaatttaaaaaattgggttttggcgggtctttaccagggtaatttcatggtttacagagagccttaaaagaa

SEQ ID NO: 288533 - DNA, 1204 bp, Homo sapiens
tttttttctgagacggagtctcactccgtcatccaggttggagtgcagtggcacaatctcagctcactgcaacctctgcctcccaggttcaagcgattctcctgcctcagcttctcaagtagctgggattacagatgtgtaccaccatgcctggctaatttttgtatttttagtagagacagggtttcaccatgttggccaggctggtctggaactcctgacctcaggtgatccgcccacctcagcctcccagagcgctgggattatgccaacctctgcctcccaaagcactgggatggcaggcatgagccaccacacccggcctgtttttgttttttagacagggtcttgctctgtcacccaggctggagtgcagtgatgcaaacatgactcactgcagctttgtcctctcaggcttaaccatcttcccacctcagcttccagaatagctgggactgcaggcgtgcacacagtatctggctaatttatttattttattttatttttgagacagggcctcgcactgtcgcccaggctagagtgcagtggcgcggtttcaactcattgcagcctcgaccctcctgggtcaagcgattcttcctgccttagtctccagagttgctgggattaccggtgtgcaccaccaagcctggctaatttttgtatttttagtagagacagggtttcactatgttggccaggctggtctggaactcctgacctgaggtgatccgcctacctcggccttccaaagtactgggaatataggcatgagccactgtttccggcctgttttttttagacagagtcttgctctgtcacccaggctggagtgcaatggtgcaaacatgactcactgcaccgtcatcctcccaggctcaaccatcttcccacctcaccctccagaatagctgggactacaggcgtgcaccacgatgcctggctaaatatttttttccagctaattttattatttttttttgagaatggcttgagcccaggagtttaaggtttgtagtgcgctagacggcgcctgtgaatagccactgcactctagtctggggaacatatgagacccctgccatctcaaaaaaaaaaaaatttttcaataaattatgtgcccacgaaatttaaatttaaaaaattgggttttggcgggtctttaccagggtaatttcatggtttacagagagccttaaaagaa

SEQ ID NO: 288534 - DNA, 252 bp, Homo sapiens
gagacagagtctcactttgtcacctaggctggagtgtagtggcgcaatcttagctcactgcaacctctgcctcccaggctcaagtgattctcccacctcagcctcccaagtagctgagactacagatgcacaccgtgacacctggctaattaagaccctcaactcttaaaaaaaaaaggctaaaatgataaattttacattatgcacattttatcacacccacataaaaaccataaaaacaaaacaaaagct

SEQ ID NO: 288535 - DNA, 481 bp, Homo sapiens
cattgacaaccccctgccttttccagaccacgtgaccagagagaagctggaccgcattctggccgttatccaaggctcccatcagaaggccctggtgatgtgagtagggccctcagggaggtactgggagagcagtaagtgcccttggctcccgtaggctcccccaaacctggggcagattccatggatcttgtttttagagcccagaaccagacgggagctacctgtttctttcttggcattaagaaatggttctgtgtgccaggtcttgggttggccaacgggaggccaagaagagcaagagaaccaagctgtcctgctgagagtatatgatctaatggcaaggaaaccagggaccacatcattggagcacagagcccaagggcaagagcagccaaggagttaagagcttgggctctggagccagcttgcctgggtttcctgactctaccaggcacctggtgatgaaggagggcaggaa

SEQ ID NO: 288536 - DNA, 1716 bp, Homo sapiens
cggcctttcgaggggaaacatcgcttcacgggcagaaggcatgtaggccaagtaggcgaaggaaacgcacgcgaactgtctaccgtctacgtccaccgatccaagactctcgccatgtcacctcgccccagaaagtgtctgcaaaggacacgcaaccacgctcactcagcgccgggccctatttccttctccacagccggttttccccgaagactataaaatgcgaacctcttccggctgtggaacatggcggcgcccgtggaaaggaccacatttgggggcggggcctggcggtacttccgtccaggtccagcgggtgctgtgatcttcaagtatggggtctgctggcttgtcgcggctgcatgggcttttcgcggtctataagcccccggggctaaaatggaagcacctgcgggatacagtggagctacaacttctgaagggtctcaatgccaggaagcctcccgctcctaaacagcgtgttcgcttcttgctgggccccatggaaggcagcgaagagaaggagctgaccctcacagccaccagcgtaccctctttcatcaaccatccactggtatgtggaccagcattcgcccatctcaaggttggcgtgggacatcggttggatgcccaggcttctggagtacttgtgctcggcgtgggacatggatgcaggctcctcaccgatatgtacaatgctcatcttaccaaggattacacagtgcgtggcctcctgggcaaagctacagatgacttccgtgaggacgggaggctggtagagaagacaacctatgaccacgtgaccagagagaagctggaccgcattctggccgttatccaaggctcccatcagaaggccctggtgatgtactccaacctcgacctgaagacccaggaggcctatgagatggccgtgagaggcctgatccggcccatgaacaagtccccgatgctgataactggcatccgatgcctctactttgcacctccggaattcctcttagaggtgcagtgcatgcatgagacgcagaaagagctgcggaagttggttcatgaaatcggcctggaactaaagaccactgctgtctgcacccaagtgcggcgcacgcgcgacggcttcttcacgctagacagtgccctcctgaggacccagtgggacctaaccaacatccaggatgctatccgggctgctacccctcaggtagctgcagagctggagaagagcttgagcccggggctggacaccaagcagctccccagtccgggatggtcctgggactcccagggcccgagctctaccttggggctggagaggggtgcggggcagtgaatgcccaggcagctcctggggcagtggatggataaatagaagaactgctatgagctggacctgatagctgtgcagaaagtgagagcaggggcaccttttctacgtaagacacaaaactcaagctgtaacagaaaggtcaatggacttgacccaactgagaaggaaaaacttctgtatggaggaaaagacagtaaacatgacagactgatagaaagtattggcagaccaggcgtggtggcgggcacttgtaatcccagctactcccaaggctgaggcaggagaattgcttgagcccaggagtttaaggttgtagtgcgctagacggcgcctgtgaatagccactgcactctagtctggggaacatatgagacccctgccatctcaaa

SEQ ID NO: 288537 - DNA, 1001 bp, Homo sapiens
cggcctttcgaggggaaacatcgcttcacgggcagaaggcatgtaggccaagtaggcgaaggaaacgcacgcgaactgtctaccgtctacgtccaccgatccaagactctcgccatgtcacctcgccccagaaagtgtctgcaaaggacacgcaaccacgctcactcagcgccgggccctatttccttctccacagccggttttccccgaagactataaaatgcgaacctcttccggctgtggaacatggcggcgcccgtggaaaggaccacatttgggggcggggcctggcggtacttccgtccaggtccagcgggtgctgtgatcttcaagtatggggtctgctggcttgtcgcggctgcatgggcttttcgcggtctataagcccccggggctaaaatggaagcacctgcgggatacagtggagctacaacttctgaagggtgagtgcctcgaaccagacccacgttcccgctctcgttctcttggaagtccatctccgcttctggtccttaccccaaaacaaaatcacgtgacctattcacctgggcagagcgctttcccaaacgcctgttctctgtgctttcttactcctcactttcctctgttttccgagggggaaactgactcagtattgttccttgtcacacggttactacgttgtagagtctgtttgaatccgcctgtttcttaactactgctatactgccctctgcaccatgggcttctgctttgtcttctacatcatacttccctgttgtctaatcccccaagtgtttggacagaacaagatattcctggtcagcatcgtggtgcacgcctgtaatcccagctactctggaggctgaggcaggaggatcgcttgagcccaagagtttgacgttacagtgagctatgatggcgccattgcacttcagcctgggctacagaacgaggccctgtctcttaaaaaatattttatatgtacatatatttgtatgtatgtgtgtatatattatctc

SEQ ID NO: 288538 - DNA, 1669 bp, Homo sapiens
cggcctttcgaggggaaacatcgcttcacgggcagaaggcatgtaggccaagtaggcgaaggaaacgcacgcgaactgtctaccgtctacgtccaccgatccaagactctcgccatgtcacctcgccccagaaagtgtctgcaaaggacacgcaaccacgctcactcagcgccgggccctatttccttctccacagccggttttccccgaagactataaaatgcgaacctcttccggctgtggaacatggcggcgcccgtggaaaggaccacatttgggggcggggcctggcggtacttccgtccaggtccagcgggtgctgtgatcttcaagtatggggtctgctggcttgtcgcggctgcatgggcttttcgcggtctataagcccccggggctgtctcaatgccaggaagcctcccgctcctaaacagcgtgttcgcttcttgctgggccccatggaaggcagcgaagagaaggagctgaccctcacagccaccagcgtaccctctttcatcaaccatccactggtatgtggaccagcattcgcccatctcaaggttggcgtgggacatcggttggatgcccaggcttctggagtacttgtgctcggcgtgggacatggatgcaggctcctcaccgatatgtacaatgctcatcttaccaaggattacacagtgcgtggcctcctgggcaaagctacagatgacttccgtgaggacgggaggctggtagagaagacaacctatgaccacgtgaccagagagaagctggaccgcattctggccgttatccaaggctcccatcagaaggccctggtgatgtactccaacctcgacctgaagacccaggaggcctatgagatggccgtgagaggcctgatccggcccatgaacaagtccccgatgctgataactggcatccgatgcctctactttgcacctccggaattcctcttagaggtgcagtgcatgcatgagacgcagaaagagctgcggaagttggttcatgaaatcggcctggaactaaagaccactgctgtctgcacccaagtgcggcgcacgcgcgacggcttcttcacgctagacagtgccctcctgaggacccagtgggacctaaccaacatccaggatgctatccgggctgctacccctcaggtagctgcagagctggagaagagcttgagcccggggctggacaccaagcagctccccagtccgggatggtcctgggactcccagggcccgagctctaccttggggctggagaggggtgcggggcagtgaatgcccaggcagctcctggggcagtggatggataaatagaagaactgctatgagctggacctgatagctgtgcagaaagtgagagcaggggcaccttttctacgtaagacacaaaactcaagctgtaacagaaaggtcaatggacttgacccaactgagaaggaaaaacttctgtatggaggaaaagacagtaaacatgacagactgatagaaagtattggcagaccaggcgtggtggcgggcacttgtaatcccagctactcccaaggctgaggcaggagaattgcttgagcccaggagtttaaggttgtagtgcgctagacggcgcctgtgaatagccactgcactctagtctggggaacatatgagacccctgccatctcaaa

SEQ ID NO: 288539 - DNA, 1584 bp, Homo sapiens
cggcctttcgaggggaaacatcgcttcacgggcagaaggcatgtaggccaagtaggcgaaggaaacgcacgcgaactgtctaccgtctacgtccaccgatccaagactctcgccatgtcacctcgccccagaaagtgtctgcaaaggacacgcaaccacgctcactcagcgccgggccctatttccttctccacagccggttttccccgaagactataaaatgcgaacctcttccggctgtggaacatggcggcgcccgtggaaaggaccacatttgggggcggggcctggcggtacttccgtccaggtccagcgggtgctgtgatcttcaagtatggggtctgctggcttgtcgcggctgcatgggcttttcgcggtctataagcccccggggctaaaatggaagcacctgcgggatacagtggagctacaacttctgaaggtatgtggaccagcattcgcccatctcaaggttggcgtgggacatcggttggatgcccaggcttctggagtacttgtgctcggcgtgggacatggatgcaggctcctcaccgatatgtacaatgctcatcttaccaaggattacacagtgcgtggcctcctgggcaaagctacagatgacttccgtgaggacgggaggctggtagagaagacaacctatgaccacgtgaccagagagaagctggaccgcattctggccgttatccaaggctcccatcagaaggccctggtgatgtactccaacctcgacctgaagacccaggaggcctatgagatggccgtgagaggcctgatccggcccatgaacaagtccccgatgctgataactggcatccgatgcctctactttgcacctccggaattcctcttagaggtgcagtgcatgcatgagacgcagaaagagctgcggaagttggttcatgaaatcggcctggaactaaagaccactgctgtctgcacccaagtgcggcgcacgcgcgacggcttcttcacgctagacagtgccctcctgaggacccagtgggacctaaccaacatccaggatgctatccgggctgctacccctcaggtagctgcagagctggagaagagcttgagcccggggctggacaccaagcagctccccagtccgggatggtcctgggactcccagggcccgagctctaccttggggctggagaggggtgcggggcagtgaatgcccaggcagctcctggggcagtggatggataaatagaagaactgctatgagctggacctgatagctgtgcagaaagtgagagcaggggcaccttttctacgtaagacacaaaactcaagctgtaacagaaaggtcaatggacttgacccaactgagaaggaaaaacttctgtatggaggaaaagacagtaaacatgacagactgatagaaagtattggcagaccaggcgtggtggcgggcacttgtaatcccagctactcccaaggctgaggcaggagaattgcttgagcccaggagtttaaggttgtagtgcgctagacggcgcctgtgaatagccactgcactctagtctggggaacatatgagacccctgccatctcaaa

SEQ ID NO: 288540 - DNA, 1791 bp, Homo sapiens
cggcctttcgaggggaaacatcgcttcacgggcagaaggcatgtaggccaagtaggcgaaggaaacgcacgcgaactgtctaccgtctacgtccaccgatccaagactctcgccatgtcacctcgccccagaaagtgtctgcaaaggacacgcaaccacgctcactcagcgccgggccctatttccttctccacagccggttttccccgaagactataaaatgcgaacctcttccggctgtggaacatggcggcgcccgtggaaaggaccacatttgggggcggggcctggcggtacttccgtccaggtccagcgggtgctgtgatcttcaagtatggggtctgctggcttgtcgcggctgcatgggcttttcgcggtctataagcccccggggctaaaatggaagcacctgcgggatacagtggagctacaacttctgaagggtctcaatgccaggaagcctcccgctcctaaacagcgtgttcgcttcttgctgggccccatggaaggcagcgaagagaaggagctgaccctcacagccaccagcgtaccctctttcatcaaccatccactggtatgtggaccagcattcgcccatctcaaggttggcgtgggacatcggttggatgcccaggcttctggagtacttggtgtcagaatcctgtggagagcttggcagggatcctaggccccctccaaccatgagtcagattcagtgcatatggtgctcggcgtgggacatggatgcaggctcctcaccgatatgtacaatgctcatcttaccaaggattacacagtgcgtggcctcctgggcaaagctacagatgacttccgtgaggacgggaggctggtagagaagacaacctatgaccacgtgaccagagagaagctggaccgcattctggccgttatccaaggctcccatcagaaggccctggtgatgtactccaacctcgacctgaagacccaggaggcctatgagatggccgtgagaggcctgatccggcccatgaacaagtccccgatgctgataactggcatccgatgcctctactttgcacctccggaattcctcttagaggtgcagtgcatgcatgagacgcagaaagagctgcggaagttggttcatgaaatcggcctggaactaaagaccactgctgtctgcacccaagtgcggcgcacgcgcgacggcttcttcacgctagacagtgccctcctgaggacccagtgggacctaaccaacatccaggatgctatccgggctgctacccctcaggtagctgcagagctggagaagagcttgagcccggggctggacaccaagcagctccccagtccgggatggtcctgggactcccagggcccgagctctaccttggggctggagaggggtgcggggcagtgaatgcccaggcagctcctggggcagtggatggataaatagaagaactgctatgagctggacctgatagctgtgcagaaagtgagagcaggggcaccttttctacgtaagacacaaaactcaagctgtaacagaaaggtcaatggacttgacccaactgagaaggaaaaacttctgtatggaggaaaagacagtaaacatgacagactgatagaaagtattggcagaccaggcgtggtggcgggcacttgtaatcccagctactcccaaggctgaggcaggagaattgcttgagcccaggagtttaaggttgtagtgcgctagacggcgcctgtgaatagccactgcactctagtctggggaacatatgagacccctgccatctcaaa

SEQ ID NO: 288541 - DNA, 2078 bp, Homo sapiens
agcagttttgagtagtgtgatgctgaactttacatgaatggctttctgtagtgagaaggcgcctgtcacccgcggcctgcagaggctgcgtggcttggagggggaaccagaggcccaaccatgggcctccttcccctggtctctacagcagcttttcccaaacccactgagatgggtcaggctcctagagagcctgagaacaaagcccctttgtgacttttgttttgaatcaggcttgtgacaaaggggaggagccactgggttgggtggatgggggtgcccggagcgcgctgttgttgcaggggaagaaaacaaaattgtgtcttttttttggcaatgttgtcttgccaatccctccctcccccagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaa

SEQ ID NO: 288542 - DNA, 857 bp, Homo sapiens
acctttttcaccctttttataatttgtttatatttttccctcttaggtggtctttaattcttctctttgggtggtggttttgtccccctctttttgttccccctccctccgacaagtaaggggtcctcttttccccacgaggttcccccggtgtctccctttttccccctcttctggccgctgttttataacccccgcgctcccccgtccctctatcgtttattatatatatcccctctctcctcttatttgggcgccccctttgttccacacacaaaactcgcggggtgcgcgtcggcgttaactagctgtgggcccccccgggggaatttttggccccccccccctcttttttttttttttttttttttttttttttttttttttttttttttttttttttgcatgggcagataggttttattttcaaaatgctgttcttaacacaaaaataaaggctttactatttacttaagacgtgtggtagcttgtcaaaacaacccagtgcaactaactactaggctttcggatctgccttgagggtcggtctgtggcattttaaatgggagaatcttggttaacagcaaaccacagaacatattaaggtaataagtttacccataaaagcaggaactttctatataatactttgggacttagacaacaaaaatcctttgttacatctgtctgggtttaagtgtctcatcttgttgggtttgcagtaaaagttaaggagtggtctcctttggaaatgatcattaagtataaggtcttttttataaagagagtagtcagtcactaggtaaacttaaaaccaaattcagaggttggggacttaaattagaatatggatcttt

SEQ ID NO: 288543 - DNA, 4542 bp, Homo sapiens
agcgggccacggccgctgcagcagcgcgggccgggccaggggcgcctcgcgcggcagcgactctggcaggcgctgcagtgaagctggacccgcaggcgggcgtgcgtggagcgggggccgcggccgcgccgcagagatgtgactcgggccgaaggccagctggagcgtcggcgctgcggggccgcgggggtcgaatgttcgtggcatcagagagaaagatgagagctcaccaggtgctcaccttcctcctgctcttcgtgatcacctcggtggcctctgaaaacgccagcacatcccgaggctgtaggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaaaggccctagtctctgctgtctcccctccccaccccatccttgcaaagcactggggaaagtaaggccaatctggccctccctgtgtgacccgccttcgagttttccttaacagttagtacatttccttgtgttaccacgcatggggaagaaaacgcatggccccagaatgccacccccacctgacctccccggaagcaccccgcctctgcccagagcatgtgcttgcttctagagaatcccgttccagtcattgcgtggacagaaaacgtaagagtcctggggaggggtgggagggaatgaagctaggacctggggtgggggtgggggcggttgcatgcggacccggtattctgaaaagaaagaaatcttcaaacacctcggtcctgtccggtgaaaaaacgacagcattacacattctcgtgccaggaaatggttactcacccccgctctctggagtcctttggagctttctgataccattcacacgatggagcaattcacacgttcgttttctaagttctttattgtccaagcatataaggtgagcacagcacaaatggctgccatggaaagtcgtgcttccccagcataagaacagagccatctttgagccatgggaagcctcatttaatgagacctttttccccccttttaaatctgatatgttatcgcacttagggttttgttttattttggcttttaaggttgagagtgggctgaacgccttcataatgggggcggaggcgggagtgagaggagaagggagagagctgttctttttctaatgactacacctgaaaagtatcaagagacatctttgccaagagactgtagcagccagctgccccccgtggagcaaggtttaaagacaaaattaaatggcacctctgtttaagatctgcgtgtgtaaacaagactcgtttggggaaaacgacccgggaggagagcatctgtgatcaaaatctctcattgtaagcacaaattgttccgtgtctggttattaaaatcgctttgggtctataacagccactcttgtccccccttttaatagaaaattgtcattctagcctggatttctccccactggaggtggagggtgggaagagaagggagtcagctctgacagcttacaaactgggaagttctgtgcatctccagggattccagagttgaagatctggttgttggaagctgggcgcccagtgcttttttttttttttttttttagcccagtaccccaattgccgtgggcccccttgaccgggggtgaccccgggggggggccccgggggggccggggttgtttgacgcctgggcaaccccttttggggggccttggggggtttataatcccatgttgctgtgttgttccagctgacaggagttctcacccagggcttttattaccggtggaaaagcaggcgcccttggcaaaaaatttttttctcaaaggctacgggtgttaaaagaacctaattcccccggaggtggcatcttaacagaagctcgaattcggaacattttcctaaggctttattcacttaaagggaccgggaagtttccacgcgtccacaagcttcttttaaaaaaaaacagaaaaaccgtgg

SEQ ID NO: 288544 - DNA, 2861 bp, Homo sapiens
agcgggccacggccgctgcagcagcgcgggccgggccaggggcgcctcgcgcggcagcgactctggcaggcgctgcagtgaagctggacccgcaggcgggcgtgcgtggagcgggggccgcggccgcgccgcagagatgtgactcgggccgaaggccagctggagcgtcggcgctgcggggccgcgggggtcgaatgttcgtggcatcagagagaaagatgagagctcaccaggtgctcaccttcctcctgctcttcgtgatcacctcggtggcctctgaaaacgccagcacatcccgaggctgtaggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaa

SEQ ID NO: 288545 - DNA, 4488 bp, Homo sapiens
agcgggccacggccgctgcagcagcgcgggccgggccaggggcgcctcgcgcggcagcgactctggcaggcgctgcagtgaagctggacccgcaggcgggcgtgcgtggagcgggggccgcggccgcgccgcagagatgtgactcgggccgaaggccagctggagcgtcggcgctgcggggccgcgggggtcgaatgttcgtggcatcagagagaaagatgagagctcaccaggtgctcaccttcctcctgctcttcgtgatcacctcggtggcctctgaaaacgccagcacatcccgaggctgtaggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatgggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaaaggccctagtctctgctgtctcccctccccaccccatccttgcaaagcactggggaaagtaaggccaatctggccctccctgtgtgacccgccttcgagttttccttaacagttagtacatttccttgtgttaccacgcatggggaagaaaacgcatggccccagaatgccacccccacctgacctccccggaagcaccccgcctctgcccagagcatgtgcttgcttctagagaatcccgttccagtcattgcgtggacagaaaacgtaagagtcctggggaggggtgggagggaatgaagctaggacctggggtgggggtgggggcggttgcatgcggacccggtattctgaaaagaaagaaatcttcaaacacctcggtcctgtccggtgaaaaaacgacagcattacacattctcgtgccaggaaatggttactcacccccgctctctggagtcctttggagctttctgataccattcacacgatggagcaattcacacgttcgttttctaagttctttattgtccaagcatataaggtgagcacagcacaaatggctgccatggaaagtcgtgcttccccagcataagaacagagccatctttgagccatgggaagcctcatttaatgagacctttttccccccttttaaatctgatatgttatcgcacttagggttttgttttattttggcttttaaggttgagagtgggctgaacgccttcataatgggggcggaggcgggagtgagaggagaagggagagagctgttctttttctaatgactacacctgaaaagtatcaagagacatctttgccaagagactgtagcagccagctgccccccgtggagcaaggtttaaagacaaaattaaatggcacctctgtttaagatctgcgtgtgtaaacaagactcgtttggggaaaacgacccgggaggagagcatctgtgatcaaaatctctcattgtaagcacaaattgttccgtgtctggttattaaaatcgctttgggtctataacagccactcttgtccccccttttaatagaaaattgtcattctagcctggatttctccccactggaggtggagggtgggaagagaagggagtcagctctgacagcttacaaactgggaagttctgtgcatctccagggattccagagttgaagatctggttgttggaagctgggcgcccagtgcttttttttttttttttttttagcccagtaccccaattgccgtgggcccccttgaccgggggtgaccccgggggggggccccgggggggccggggttgtttgacgcctgggcaaccccttttggggggccttggggggtttataatcccatgttgctgtgttgttccagctgacaggagttctcacccagggcttttattaccggtggaaaagcaggcgcccttggcaaaaaatttttttctcaaaggctacgggtgttaaaagaacctaattcccccggaggtggcatcttaacagaagctcgaattcggaacattttcctaaggctttattcacttaaagggaccgggaagtttccacgcgtccacaagcttcttttaaaaaaaaacagaaaaaccgtgg

SEQ ID NO: 288546 - DNA, 2853 bp, Homo sapiens
actaacctatgaggattttttaatttgagagccctcaaatgggccagtggtctagtcagcattgggaaatgaagatgatgagatcctgtaactcggaaaagatatcagaggaatgttcgtggcatcagagagaaagatgagagctcaccaggtgctcaccttcctcctgctcttcgtgatcacctcggtggcctctgaaaacgccagcacatcccgaggctgtaggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaa

SEQ ID NO: 288547 - DNA, 1706 bp, Homo sapiens
agcgggccacggccgctgcagcagcgcgggccgggccaggggcgcctcgcgcggcagcgactctggcaggcgctgcagtgaagctggacccgcaggcgggcgtgcgtggagcgggggccgcggccgcgccgcagagatgtgactcgggccgaaggccagctggagcgtcggcgctgcggggccgcgggggtcgaatgttcgtggcatcagagagaaagatgagagctcaccaggtgctcaccttcctcctgctcttcgtgatcacctcggtggcctctgaaaacgccagcacatcccgaggctgtaggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacactgtttgggggccgggggaggactgaccgcttcataagccagtacgtctgagctgagtatgtttcaataaaccttttgatatttctcaa

SEQ ID NO: 288548 - DNA, 2629 bp, Homo sapiens
tacaaggccgctgagtgatgggacatgcaaggaggagttcacagtcaacggcgacccagtcaagaaggtgatctgcaccgggcccaacgacacgtcgccgggcagcccccgccacacggtgcctcagtgttgctacggcttttgcatcgacctgctcatcaagctggcacggaccatgaacttcacctacgaggtgcacctggtggcagatggcaagttcggcacacaggagcgggtgaacaacagcaacaagaaggagtggaatgggatgatgggcgagctgctcagcgggcaggcagacatgatcgtggcgccgctaaccataaacaacgagcgcggggccttgtacgcagggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaa

SEQ ID NO: 288549 - DNA, 2114 bp, Homo sapiens
agcgggccacggccgctgcagcagcgcgggccgggccaggggcgcctcgcgcggcagcgactctggcaggcgctgcagtgaagctggacccgcaggcgggcgtgcgtggagcgggggccgcggccgcgccgcagagatgtgactcgggccgaaggccagctggagcgtcggcgctgcggggccgcgggggtcgaatgttcgtggcatcagagagaaagatgagagctcaccaggtgctcaccttcctcctgctcttcgtgatcacctcggtggcctctgaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaa

SEQ ID NO: 288550 - DNA, 1850 bp, Homo sapiens
ttgcggcaagcctgcaaggagactctagagggttccctgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaa

SEQ ID NO: 288551 - DNA, 1193 bp, Homo sapiens
ctataggtctagtacgaggctggtgtgctggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaa

SEQ ID NO: 288552 - DNA, 1054 bp, Homo sapiens
ataagctaaggtagctgctggctgatcggacgaggtctctctctctctcccccgctcccgtcctcccccctcatttaatgagacctttttccccccttttaaatctgatatgttatcgcacttagggttttgttttattttggcttttaaggttgagagtgggctgaacgccttcataatgggggcggaggcgggagtgagaggagaagggagagagctgttctttttctaatgactacacctgaaaagtatcaagagacatctttgccaagagactgtagcagccagctgccccccgtggagcaaggtttaaagacaaaattaaatggcacctctgtttaagatctgcgtgtgtaaacaagactcgtttggggaaaacgacccgggaggagagcatctgtgatcaaaatctctcattgtaagcacaaattgttccgtgtctggttattaaaatcgctttgggtctataacagccactcttgtccccccttttaatagaaaattgtcattctagcctggatttctccccactggaggtggagggtgggaagagaagggagtcagctctgacagcttacaaactgggaagttctgtgcatctccagggattccagagttgaagatctggttgttggaagctgggcgcccagtgcttttttttttttttttttttagcccagtaccccaattgccgtgggcccccttgaccgggggtgaccccgggggggggccccgggggggccggggttgtttgacgcctgggcaaccccttttggggggccttggggggtttataatcccatgttgctgtgttgttccagctgacaggagttctcacccagggcttttattaccggtggaaaagcaggcgcccttggcaaaaaatttttttctcaaaggctacgggtgttaaaagaacctaattcccccggaggtggcatcttaacagaagctcgaattcggaacattttcctaaggctttattcacttaaagggaccgggaagtttccacgcgtccacaagcttcttttaaaaaaaaacagaaaaaccgtgg

SEQ ID NO: 288553 - DNA, 2935 bp, Homo sapiens
agcgggccacggccgctgcagcagcgcgggccgggccaggggcgcctcgcgcggcagcgactctggcaggcgctgcagtgaagctggacccgcaggcgggcgtgcgtggagcgggggccgcggccgcgccgcagagatgtgactcgggccgaaggccagctggagcgtcggcgctgcggggccgcgggggtcgaatgttcgtggcatcagagagaaagatgagagctcaccaggtgctcaccttcctcctgctcttcgtgatcacctcggtggcctctgaaaacgccagcacatcccgaggctgtaggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaa

SEQ ID NO: 288554 - DNA, 4315 bp, Homo sapiens
agcgggccacggccgctgcagcagcgcgggccgggccaggggcgcctcgcgcggcagcgactctggcaggcgctgcagtgaagctggacccgcaggcgggcgtgcgtggagcgggggccgcggccgcgccgcagagatgtgactcgggccgaaggccagctggagcgtcggcgctgcggggccgcgggggtcgaatgttcgtggcatcagagagaaagatgagagctcaccaggtgctcaccttcctcctgctcttcgtgatcacctcggtggcctctgaaaacgccagcacatcccgaggctgtaggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaaaggccctagtctctgctgtctcccctccccaccccatccttgcaaagcactggggaaagtaaggccaatctggccctccctgtgtgacccgccttcgagttttccttaacagttagtacatttccttgtgttaccacgcatggggaagaaaacgcatggccccagaatgccacccccacctgacctccccggaagcaccccgcctctgcccagagcatgtgcttgcttctagagaatcccgttccagtcattgcgtggacagaaaacgtaagagtcctggggaggggtgggagggaatgaagctaggacctggggtgggggtgggggcggttgcatgcggacccggtattctgaaaagaaagaaatcttcaaacacctcggtcctgtccggtgaaaaaacgacagcattacacattctcgtgccaggaaatggttactcacccccgctctctggagtcctttggagctttctgataccattcacacgatggagcaattcacacgttcgttttctaagttctttattgtccaagcatataaggtgagcacagcacaaatggctgccatggaaagtcgtgcttccccagcataagaacagagccatctttgagccatgggaagcctcatttaatgagacctttttccccccttttaaatctgatatgttatcgcacttagggttttgttttattttggcttttaaggttgagagtgggctgaacgccttcataatgggggcggaggcgggagtgagaggagaagggagagagctgttctttttctaatgactacacctgaaaagtatcaagagacatctttgccaatgactgttgcatacttataaaaaagaagttaaagaaatttcaagacaatcaatatgtaccataaacgactatataaatattacaaatttaaaaggctgtaaagcatgggcagataggttttattttcaaaatgctgttcttaacacaaaaataaaggctttactatttacttaagacgtgtggtagcttgtcaaaacaacccagtgcaactaactactaggctttcggatctgccttgagggtcggtctgtggcattttaaatgggagaatcttggttaacagcaaaccacagaacatattaaggtaataagtttacccataaaagcaggaactttctatataatactttgggacttagacaacaaaaatcctttgttacatctgtctgggtttaagtgtctcatcttgttgggtttgcagtaaaagttaaggagtggtctcctttggaaatgatcattaagtataaggtcttttttataaagagagtagtcagtcactaggtaaacttaaaaccaaattcagaggttggggacttaaattagaatatggatcttt

SEQ ID NO: 288555 - DNA, 2856 bp, Homo sapiens
cgcccgggcaggttagaattcagcggccgctgaattctacgcggccgcgccgcagagatgtgactcgggccgaaggccagctggagcgtcggcgctgcggggccgcgggggtcgaatgttcgtggcatcagagagaaagatgagagctcaccaggtgctcaccttcctcctgctcttcgtgatcacctcggtggcctctgaaaacgccagcacatcccgaggctgtaggctggacctcctccctcagtacgtgtccctgtgcgacctggacgccatctggggcattgtggtggaggcggtggccggggcgggcgccctgatcacactgctcctgatgctcatcctcctggtgcggctgcccttcatcaaggagaaggagaagaagagccctgtgggcctccactttctgttcctcctggggaccctgggcctctttgggctgacgtttgccttcatcatccaggaggacgagaccatctgctctgtccgccgcttcctctggggcgtcctctttgcgctctgcttctcctgcctgctgagccaggcatggcgcgtgcggaggctggtgcggcatggcacgggccccgcgggctggcagctggtgggcctggcgctgtgcctgatgctggtgcaagtcatcatcgctgtggagtggctggtgctcaccgtgctgcgtgacacaaggccagcctgcgcctacgagcccatggactttgtgatggccctcatctacgacatggtactgcttgtggtcaccctggggctggccctcttcactctgtgcggcaagttcaagaggtggaagctgaacggggccttcctcctcatcacagccttcctctctgtgctcatctgggtggcctggatgaccatgtacctcttcggcaatgtcaagctgcagcagggggatgcctggaacgaccccaccttggccatcacgctggcggccagcggctgggtcttcgtcatcttccacgccatccctgagatccactgcacccttctgccagccctgcaggagaacacgcccaactacttcgacacgtcgcagcccaggatgcgggagacggccttcgaggaggacgtgcagctgccgcgggcctatatggagaacaaggccttctccatggatgaacacaatgcagctctccgaacagcaggatttcccaacggcagcttgggaaaaagacccagtggcagcttggggaaaagacccagcgctccgtttagaagcaacgtgtatcagccaactgagatggccgtcgtgctcaacggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagcccttttccaagcccattgtttctgtcatggtttccatctgtcctgagcaagtcattcctttgttatttagcatttcgaacatctcggccattcaaagcccccatgttctctgcactgtttggccagcataacctctagcatcgattcaaagcagagttttaacctgacggcatggaatgtataaatgagggtgggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttctcaa

SEQ ID NO: 288556 - DNA, 1977 bp, Homo sapiens
tatttttgttttctctcctctgtgttggtcgcctgtctcgctccctctcatgctctctttctctcctctattttgtctctcactattcgtgttttgtgtttgtttctaggtttggctcaattggtaagggtgggattgaatttgctgagccccctagtgtaacagtcttctgcctttgtgggtaaagagtggagagggggagggggacgacagacagacatcccttcttcccacccccctccccacctgccccccggcaaccgagggtgcccatttggtttggtttctattgtacagacatctcaggatggctcacataggcgggaaggagggaagtcgtcacagggcagttttcttggctgtgacctccttccccacccctccctggctggtgttctggaggggaaggctgtggagaggtgttaattctcgacaggaggaaggagaggaggaaatcccctctgcacctccacctgctccatccaggaagaatgggactctggagctttaagtgctcgggtgatcactcagaacagtcccaccccactatttacaaggatctcctgggactcccatccctccatcctctcttggcccggccagcggaaccaggagggtggagagctggtggcagccccaaatgagcaggagggaagcagcaaagggggtgcaaggcctgtaacaatatgtgattctcagaataggccctgctgcccacctccccccagtcctgctttgccccaggctgacccctctttgaagacctggcttctcctcaaccacatcaggtgggacacagactccatgatttgcatggaggattcaagctaataaggattcaagctaataaggattcaataaaggttcaggtcaggttgagaggggtgcagggagtcgggcactgcatgggaggagcagctcttccctccaccagtctctcctcctgcctcacgccctttcctgctcctttaaatagcagacacactactctggcgcccccacttccacaaccagaaaatccagcccaagaactactccctaaatataatgcccatagtgatgaaggtgggggtttgaccctttaccccagtattagtcccctcctcacattttcactgagaatggggatacattccatcaataatttgagatgtttctttggaggagtgggggagagggcctccagatgcctgaagaggaatggagggaccatccaaatattcctccccctacttctccccagaaggatggtgtccccaaagctgggctggtaggggcaggggcagggggaagggaagaaagacaaagacaaggaacaagacagagctgggagtgacagccaccaaaagaaagcaaagcaaagagctggagggaaaggaaagagttgaggaaagggaagatcccaaaggaagggaagataggcggagagagtgaagggaaacactgcgggggacaggggcagagaggaggactcctctccagattcctctagcccagctttgtggggacagatggcttctgagcctttcagccacagaaacgattgacatgcttctctccccaacccctagaagatctatgcaacttctgataggactccaactcccttacactgctggaaactggtgacagtttcccaaacaggatatgggggtggggtgggaggtaaagggtcatgttaggaggtcggaggtcaggaccagagggcttagggattgcaaagagcacctctagatacaggtggtaattctccctctcccttttacccaccccctcctcggaagaaggggtggagtgacacacagcgggggaggtgggcagagggcgtcagaatgccttagtggccacctctggcaaaacaaaagtttctcttagctgcttccagatttaagggtgtgttgaggtatcagagttgtaactctagtaaaattttcagtctggccccctcccaatctttccaggacagggtgaccagag

SEQ ID NO: 288557 - DNA, 4404 bp, Homo sapiens
tatttttgttttctctcctctgtgttggtcgcctgtctcgctccctctcatgctctctttctctcctctattttgtctctcactattcgtgttttgtgtttgtttctaggtttggctcaattgctgccccggggacgatgaacggaggataaatggtgcccaaggcagacagcggcgccttcctgctgctcttcctgctcgtgctcactgtcaccgagccgctgcggccagagctgcggtgcaaccctgggcagtttgcgtgtcgcagcggcaccatccagtgcatccccctcccctggcagtgtgacggctgggcgacttgcgaggatgagagcgacgaagccaactgtccagaagtgaccggggaggtgcgtcctcatcatgggaaggaggctgtggatccgcggcaggggcgggccagaggaggcgacccttcgcacttccacgcggtgaacgtggcgcagcccgttcgcttcagcagtttcctagggaagtgcccgacagggtggcaccactacgaaggcacggccagctgctaccgggtctacctgagcggggagaactactgggatgccgcgcagacctgccagcgcctgaatggctctctcgccaccttctccactgaccaggagctgcgctttgtcctggcccaggaatgggaccagcccgagcggagctttggttggaaggaccagcgcaagttgtgggttggctatcagtatgttatcactggccggaaccgctccttggaaggtcgctgggaggtggcattcaaaggctcttcagaggtgttcctgcccccagaccccatctttgcctcggccatgtctgagaacgacaacgtgttctgtgcccagcttcagtgcttccatttccccaccctgcggcaccacgacctccacagctggcacgccgagagctgctacgagaagtcttcatttctgtgtaaaagaagtcaaacatgtgttgacatcaaggacaacgtggtggatgaagggttctacttcacccctaagggggacgacccatgcctgagctgcacctgccatggaggggagcctgagatgtgtgtggctgctctctgtgagaggccccagggctgccaacagtaccgcaaggaccccaaagagtgctgcaagttcatgtgtctggacccagatggcaacagtctgtttgactccatggccagcgggatgcgcctggtcgtcagctgcatctcctccttcctcatcctgtcactgctgctcttcatggtccaccggctgcgccagcggcgccgggagcgcatcgagtccctgattggagcaaacttgcaccacttcaacctcggccgcaggatccctggctttgattacggcccagacgggtttggcacgggcctcacgccgctgcatctttctgacgacggagagggtgggactttccatttccacgaccctccacctccctacacggcatacaagtacccggacatcggccagcccgacgaccctccgccgccctacgaggcctccatccacccggacagtgtgttctatgaccctgcagacgatgatgcttttgagcctgtggaggtcagcctgccagcccctggggatggtgggagtgaaggtgcattactccggcgcctggagcagcctctgcccactgcgggggcctctctggcagacctggaagactctgccgacagcagcagcgccctgctcgtgccccctgaccctgcccagagcgggagcaccccagctgcagaggcactgccagggggtggccgccacagccgcagctccctcaatactgtggtgtagacggcctggcctgtaccccaacggtctgggagcacctgtctgttgcagaaaacaccggtccctggggagacttgaaaggcccctgtcccagcctggacgccacgcactgccgcacgtcactggcgggctcgcgtgtgtacatagagaccacagcccgccttctgccaaaagaagtgatggcctgcaccgagcttccttgagggcttcagaaacatgcatagctttggatcactgtcttctcctttataaatggcagaagagtgacaaaattcattcagaccgcacatgttagaggcagggaatgaagaaggtactgtgggccatggccacacctgatgcgtttttggtgggcctacttggtgcagtgtgctgtccagagagacctgctgacccagtctgggacaggcacagtgggagctgccacagtgccccttgctggccgccctcaggagggggcctctggaccgtcagtgtggcgtaggcagtgggtctgcttcagggaggcagcctcttgactttgtcacaacggttgcactgaagatggcccccacaagcccagttgtgaatatcaaggtgaccctgcccctggctgggagctcccctggggctctggaacctgaagccctgagaaggagagcttggaaggaggttgagctcttcactgtgtctttccatctgggctctgcagcccagctctgtggcaggaggcctgaccccaccccatcagtccctctcccagcattgctgtgcatggctccctcaggaagaagctctggagtggggccgaggccccagatgctctgctggggtctggggactgagctgcctcctgtctctccactctggagccctgggctcttgcctcctgttgaattgcccctgggcctgcccccggccccatttgtgccataaagggttgcttcattgcaggaggggtggctgaaaccaccatcctgggctgcatctatctccttaaagtccactccttacatcaccgccactactgcagctcagtgcccagtggccgcatgcacacctcccggcccctcctcagcagcgcaggggctgggggcccttcctggcacccttttgcctgacggaccctgttgcctgctcctgggcagtggttttgttgcctgacacagggcctttaacatttctgaggtttggagattaagcgggttctgtgcgatttttagcacatccatatcttttctacgttgaatgtctggatctttcctttgtatgtttgtgtctctgtgtgtgtatgtggccaagcgtctgcaggtgagggtggcacatgaaacttcacgggtcactgggggcccactcttccagggtcatcgatgcatcctgggctgtgctgaggcagtgctgtctcgctcagtctttccagaccagcggggcagcacctgggaggcctgtctgaagcatgcagttctgtggtgctgctcggggatggactccatgcacagtccacttcttgacacattctcacactgtggctggagacccattttttccatcccatgtggaatgagaatcttgagttgcccacagacagacttgacctttgtgccagaactgtccagagctgtgagttttgttactgaattgcctgtccctgagcttggcctgctggagcatgatgctggaggctgtgtgcgggcaggcttgtgctccccttggagaagggctgctacttaacaaggaagtcctggccacaagagtcccctactggctgcagaggacgaagcaggaagcatgccgtggatcccacatgcactggggcagggcagccaggttccagagcagcaggcatgtgcattatgggtgccaggtggccagtgagggcccgaggaccacgcagcagagtcccccacgggcctgagcctgagagctcagaggattcctgccaggcctcagaactgtgtgtgcgggacagggtggctggcacgagatgtgtgggactgggacgcttcctttggggaccagaggaacattaggggccggtcagacacgtagggggcagtgaggaaacggggtaaagtggaccatgcaggctgcagagggtgggccttgggctggccggggttgctgggtggccccttccccatgggcctccacaagcactcgggcctccacaagcactcaggccactggcacgttgggccaggcagaaggtccacatggcagggctgcctggaacaccgctgccactgtggctccaggaggcccttgggagcatgaggagagctggactcgctcatctgttcttgcaccaccatccagaatgccccctttgcaaggcctgctgcagtccccagtctgaccagcaagtcccggggtcacccttgctgaaccttgtgctccaggggtcctcctcctctaggaccagcttgccacggtttctcagagcccaggtgccctctgacctgccatgcggaggtgggatttgatactgtacattgtcttgatgcctgtttttttatgttttcattaagggtttttagtttttggttgggttgacactaacttttcttaagatgctgtgagaatcatttcatccaaatgccaaataaacttgtgttccggaaaa
